(12) United States Patent
Walker et al.

(10) Patent No.: US 8,143,380 B2
(45) Date of Patent: Mar. 27, 2012

(54) THERAPEUTIC PEPTIDES

(75) Inventors: Kenneth W. Walker, Newbury Park, CA (US); Olaf B. Kinstler, Newbury Park, CA (US); Karen C. Sitney, Weston, CT (US)

(73) Assignee: Amgen Inc., Thousand Oaks, CA (US)

( * ) Notice: Subject to any disclaimer, the term of this patent is extended or adjusted under 35 U.S.C. 154(b) by 162 days.

(21) Appl. No.: 11/631,461

(22) PCT Filed: Jul. 8, 2005

(86) PCT No.: PCT/US2005/024373
§ 371 (c)(1),
(2), (4) Date: Dec. 19, 2007

(87) PCT Pub. No.: WO2006/010057
PCT Pub. Date: Jan. 26, 2006

(65) Prior Publication Data
US 2008/0254020 A1    Oct. 16, 2008

Related U.S. Application Data

(60) Provisional application No. 60/586,419, filed on Jul. 8, 2004.

(51) Int. Cl.
*C07K 16/00* (2006.01)
(52) U.S. Cl. .................. 530/391.7; 530/350; 530/391.1
(58) Field of Classification Search ............... None
See application file for complete search history.

(56) References Cited

U.S. PATENT DOCUMENTS

| | | | |
|---|---|---|---|
| 3,691,016 A | 9/1972 | Patel et al. |
| 3,941,763 A | 3/1976 | Sarantakis |
| 3,969,287 A | 7/1976 | Jaworek et al. |
| 4,002,531 A | 1/1977 | Royer |
| 4,179,337 A | 12/1979 | Davis et al. |
| 4,195,128 A | 3/1980 | Hildebrand et al. |
| 4,229,537 A | 10/1980 | Hodgins et al. |
| 4,247,642 A | 1/1981 | Hirohara et al. |
| 4,289,872 A | 9/1981 | Denkewalter et al. |
| 4,330,440 A | 5/1982 | Ayers et al. |
| 4,904,584 A | 2/1990 | Shaw |
| 4,925,673 A | 5/1990 | Steiner et al. |
| 5,013,556 A | 5/1991 | Woodle et al. |
| 5,089,261 A | 2/1992 | Nitecki et al. |
| 5,223,409 A | 6/1993 | Ladner et al. |
| 5,229,490 A | 7/1993 | Tam |
| 5,252,714 A | 10/1993 | Harris et al. |
| 5,281,698 A | 1/1994 | Nitecki |
| 5,284,656 A | 2/1994 | Platz et al. |
| 5,338,665 A | 8/1994 | Schatz et al. |
| 5,362,852 A | 11/1994 | Geoghegan |
| 5,432,018 A | 7/1995 | Dower et al. |
| 5,480,981 A | 1/1996 | Goodwin et al. |
| 5,498,530 A | 3/1996 | Schatz et al. |
| 5,608,035 A | 3/1997 | Yanofsky et al. |
| 5,733,731 A | 3/1998 | Schatz et al. |
| 5,739,277 A | 4/1998 | Presta et al. |
| 5,773,569 A | 6/1998 | Wrighton et al. |
| 5,786,331 A | 7/1998 | Barrett et al. |
| 5,792,451 A | 8/1998 | Sarubbi et al. |
| 5,808,029 A | 9/1998 | Brockhaus et al. |
| 5,824,784 A | 10/1998 | Kinstler et al. |
| 5,834,594 A | 11/1998 | Hakimi et al. |
| 5,869,451 A | 2/1999 | Dower et al. |
| 5,869,452 A | 2/1999 | Ng et al. |
| 5,877,151 A | 3/1999 | Pereira |
| 5,880,096 A | 3/1999 | Barrett et al. |
| 5,880,103 A | 3/1999 | Urban et al. |
| 5,886,150 A | 3/1999 | Duchesne et al. |
| 5,888,763 A | 3/1999 | Hanafusa et al. |
| 5,922,545 A | 7/1999 | Mattheakis et al. |
| 5,932,946 A | 8/1999 | Miyasaka et al. |
| 5,945,507 A | 8/1999 | Montelaro et al. |
| 5,985,265 A | 11/1999 | Kinstler et al. |
| 6,423,685 B1 | 7/2002 | Drummond et al. |
| 6,433,135 B1 | 8/2002 | El-Tayar et al. |
| 6,586,398 B1 | 7/2003 | Kinstler et al. |
| 6,635,646 B1 | 10/2003 | Laughlin |
| 2003/0096400 A1 | 5/2003 | Kinstler |
| 2004/0181033 A1 | 9/2004 | Han et al. |

FOREIGN PATENT DOCUMENTS

| | | |
|---|---|---|
| EP | 0 154 316 | 9/1985 |
| EP | 0 315 456 | 5/1989 |
| EP | 0 335 423 | 10/1989 |
| EP | 0 401 384 | 12/1990 |
| EP | 0 442 724 | 8/1991 |
| EP | 0 473 268 | 3/1992 |
| EP | 0 539 167 | 4/1993 |
| EP | 0 714 912 | 6/1996 |
| EP | 0 770 624 | 5/1997 |
| EP | 0 911 393 | 4/1999 |
| WO | WO-90/04606 | 5/1990 |
| WO | WO-90/07938 | 7/1990 |

(Continued)

OTHER PUBLICATIONS

Abuchowski et al., "Cancer therapy with chemically modified enzymes. I. antitumor properties of polyethylene glycol-asparaginase conjugates," *Cancer Biochem. Biophys.*, 7:175-186 (1984).

Abuchowski et al., "Effect of covalent attachment of polyethylene glycol on immunogenicity and circulating life of bovine liver catalase," *J. Biol. Chem.*, 252:3582-3586 (1977).

Abuchowski et al., Soluble Polymer-Enzyme Adducts, Enzymes as Drugs, Hocenberg and Roberts, editors, Wiley-Interscience, New York, NY, 367-383 (1981).

Adey et al., "Isolation of peptides from phage-displayed random peptide libraries that interact with the talin-binding domain of vinculin," *Biochem. J.*, 324:523-528 (1997).

Adey et al., "Identification of calmodulin-binding peptide consensus sequences from a phage-displayed random peptide library," *Gene*, 169:133-134 (1996).

(Continued)

*Primary Examiner* — Sheela J Huff

(57) ABSTRACT

The invention relates to compounds that exhibit improved bioefficacy in multidose administration. More specifically, the invention relates to polypeptides or peptides modified to include an antibody Fc region and one or more water soluble polymers.

11 Claims, 1 Drawing Sheet

FOREIGN PATENT DOCUMENTS

| | | |
|---|---|---|
| WO | WO-92/16221 | 10/1992 |
| WO | WO-93/21259 | 10/1993 |
| WO | WO-94/13322 | 6/1994 |
| WO | WO-95/14714 | 6/1995 |
| WO | WO-95/18858 | 7/1995 |
| WO | WO-95/21919 | 8/1995 |
| WO | WO-95/21920 | 8/1995 |
| WO | WO-95/26746 | 10/1995 |
| WO | WO-96/05309 | 2/1996 |
| WO | WO-96/11214 | 4/1996 |
| WO | WO-96/11953 | 4/1996 |
| WO | WO-96/30057 | 10/1996 |
| WO | WO-96/32478 | 10/1996 |
| WO | WO-96/40772 | 12/1996 |
| WO | WO-96/40987 | 12/1996 |
| WO | WO-97/08203 | 3/1997 |
| WO | WO-97/41220 | 4/1997 |
| WO | WO-97/23183 | 7/1997 |
| WO | WO-97/23614 | 7/1997 |
| WO | WO-97/31019 | 8/1997 |
| WO | WO-97/34631 | 9/1997 |
| WO | WO-97/35969 | 10/1997 |
| WO | WO-97/40070 | 10/1997 |
| WO | WO-98/09985 | 3/1998 |
| WO | WO-98/10795 | 3/1998 |
| WO | WO-98/15833 | 4/1998 |
| WO | WO-98/28427 | 7/1998 |
| WO | WO-98/33812 | 8/1998 |
| WO | WO-98/46751 | 10/1998 |
| WO | WO-98/53842 | 12/1998 |
| WO | WO-99/24462 | 5/1999 |
| WO | WO-99/38526 | 8/1999 |
| WO | WO-99/45944 | 9/1999 |
| WO | WO-99/47151 | 9/1999 |
| WO | WO-99/50282 | 10/1999 |
| WO | WO-99/51254 | 10/1999 |
| WO | WO-99/60013 | 11/1999 |
| WO | WO-99/61476 | 12/1999 |
| WO | WO-99/62539 | 12/1999 |
| WO | WO-00/01402 | 1/2000 |
| WO | WO-00/04048 | 1/2000 |
| WO | WO-00/11028 | 3/2000 |
| WO | 00/24782 * | 5/2000 |
| WO | WO-00/24770 | 5/2000 |
| WO | WO-00/47740 | 8/2000 |
| WO | WO 03/031589 A2 | 4/2003 |
| WO | WO-2004/058988 | 7/2004 |

OTHER PUBLICATIONS

Adjei et al., "Bioavailability of leuprolide following intratracheal administration to beagle dogs," *Int. J. Pharmaceutics*, 63:135-144 (1990).

Adjei et al., "Pulmonary delivery of peptide drugs: Effect of particle size on bioavailability of leuprlide acetate in healthy male volunteers," *Pharma. Res.*, 7:565-569 (1990).

Akeson et al., "AF12198, a novel low molecular weight antagonist, selectively binds human type I interleukin (IL) receptor and blocks in vivo responses to IL-1," *J. Biol. Chem.*, 271:30517-30523 (1996).

Alberts et al., "Synthesis of a novel hematopoietic peptide, SK& F 107647," *Thirteenth Am. Pep. Symp.*, Jun. 20-25, Edmonton, Alberta, Canada, 367-369 (1993).

Ball et al., "Cell-cycle arrest and inhibition of CDK4 activity by small peptides based on the carboxy-terminal domain of $p21^{WAF1}$," *Curr. Biol.*, 7:71-80 (1997).

Barna et al., "Combination therapy with a synthetic peptide of C-reactive protein and interleukin 2: augmented survival and eradication of pulmonary metastases," *Cancer Immunol. Immunother.*, 38:38-42 (1994).

Beauchamp et al., "A new procedure for the synthesis of polyethylene glycol-protein adducts; effects on function, and clearance of superoxide dismutase, lactoferrin, and $\alpha_2$-macroglobulin," *Ann. Biochem.*, 131:25-33 (1983).

Bhatnagar et al., "Structure-activity relationships of novel hematoregulatory peptides," *J. Med. Chem.*, 39:3814-3819 (1996).

Blank et al., "Prevention of experimental antipholipid syndrome and endothelial cell activation by synthetic peptides," *Proc. Natl. Acad. Sci.* (USA), 96:5164-5168 (1999).

Bottger et al., "Molecular characterization of the HDM2-p53 interaction," *J. Mol. Biol.*, 269:744-756 (1997).

Bottger et al., "Identification of novel MDM2 binding peptides by phage display," *Oncogene*, 13:2141-2147 (1996).

Braquet et al., "Effect of endothelin-1 on blood pressure and bronchopulmonary system of the guinea pig," *J. Cardiovasc. Pharmacol.*, 13(Suppl. 5):S143-S146 (1989).

Burnstein et al., "Thymic humoral factor γ2: Purification and amino acid sequence of an immunoregulatory peptide from calf thymus," *Biochem.*, 27:4066-4071 (1988).

Capon et al., "Designing CD4 immunoadhesins for AIDS therapy," *Nature*, 337:525-531 (1989).

Chan et al., "HIV entry and its inhibition," *Cell*, 93:681-684 (1998).

Chirinos-Rojas et al., "A peptidomimetic antagonist of TNF-α-mediated cytotoxicity identified from a phage-displayed random peptide library," *J. Immunol.*, 15:5621-5626 (1998).

Clackson et al., "A hot spot of binding energy in a hormone-receptor interface," *Science*, 267:383-386 (1995).

Conforti et al., "PEG superoxide dismutase derivatives: Anti-inflammatory activity in carrageenan pleurisy in rats," *Pharm. Res. Comm.*, 19:287-294 (1987).

Cooper et al., "Purification and characterization of a peptide from amyloid-rich pancreases of type 2 diabetic patients," *Proc. Natl. Acad. Sci.* (USA), 84:8628-8632 (1987).

Cortese et al., "Selection of biologically active peptides by phage display of random peptide libraries," *Curr. Opin. Biotech.*, 7:616-621 (1996).

Creighton, Proteins: Structure and Molecule Properties, W.H. Freeman & Co., San Francisco, 70-86 (1983).

Cuthbertson et al., "Design of low molecular weight hematoregulatory agents from the structure-activity relationship of a dimeric pentapeptide," *J. Med. Chem.*, 40:2876-2882 (1997).

Cwirla et al., "Peptide agonist of the thrombopoietin receptor as potent as the natural cytokine," *Science*, 276:1696-1699 (1997).

Davis et al., "Preparation and characterization of antibodies with specificity for the amino-terminal tetrapeptide sequence of the platelet-derived connective tissue activating peptide-III," *Biochem. Int.*, 10:395-404 (1985).

Debs et al., "Lung-Specific delivery of cytokines induces sustained pulmonary and systemic immunomodulation in rats[1]," *J. Immunol.*, 140:3482-3488 (1988).

Dedman et al., "Selection of targeted biological modifiers from a bacteriophage library of random peptides," *J. Biol. Chem.*, 268:23025-23030 (1993).

Delgado et al., "Coupling of PEG to proteins by activation with tresyl chloride, applications in immunoaffinity cell partitioning," Fisher et al., editors, *Separations Using Aqueous Phase Systems, Applications in Cell Biology and Biotechnology*, Plenum Press, New York, NY, 211-213 (1989).

Devlin et al., "Selection of targeted biological modifiers from a bacteriophage library of random peptides," *Science*, 249:404-406 (1990).

Dyson et al., Selection of peptide inhibitors of interactions involved in complex protein assemblies: Association of the core and surface antigens of hepatitis B virus, *Proc. Natl. Acad. Sci.* (USA), 92:2194-2198 (1995).

Ellison et al., "The nucleotide sequence of a human immunoglobulin Cγ1 gene." *Nucleic Acids Res.*, 10:4071-4079 (1982).

Erickson et al., Solid-phase peptide synthesis, The Proteins (3rd Edition), 2:257-527 (1976).

Fahraeus et al., "Inhibition of pRb phosphorylation and cell-cycle progression by a 20-residue peptide derived from $p16^{CDKN2/INK4A}$," *Curr. Biol.*, 6:84-91 (1996).

Fairbrother et al., Novel peptides selected to bind vascular endothelial growth factor target the receptor-binding site, *Biochem.*, 37:17754-17764 (1998).

Fields et al., "A spectrophotometric method for the microdetermination of periodate," *Biochem. J.*, 108:883-887 (1968).

Finn et al., "The synthesis of peptides by solution methods with emphasis on peptide hormones[1]," *The Proteins (3rd Edition)*, 2:105-253 (1976).

Fisher et al., "Treatment of septic shock with tumor necrosis factor receptor: Fc fusion protein," *N. Engl. Med.*, 334:1697-1702 (1996).

Francis et al., "PEG-modified Proteins," Stability of Protein Pharmaceuticals, Part B: In Vivo Pathways of Degradation and Strategies for Protein Stabilization, edited by Ahern and Mannin, Plenum Press, 235-263 (1992).

Francis et al., "Protein modification and fusion proteins," *Focus on Growth Factors*, 3:4-10 (1992).

Fukumoto et al., "Peptide mimics of the CTLA4-binding domain stimulate T-cell proliferation," *Nature Biotech.*, 16:267-270 (1998).

Gaertner et al., "Construction of protein analogues by site-specific condensation of unprotected fragments," *Bioconj. Chem.*, 3:262-268 (1992).

Gaertner et al., "Site-specific attachment of functionalized poly(ethylene glycol) to the amino terminus of proteins," *Bioconj. Chem.*, 7:38-44 (1996).

Gaertner et al., "Chemo-enzymic backbone engineering of proteins," *J. Biol. Chem.*, 269:7224-7230 (1994).

Gan et al., "A potent platelet aggregation inhibitor from the venom of the viper, ECHIS carinatus," *J. Biol. Chem.*; 263:19827-19832 (1988).

Geoghegan et al., Site-directed conjugation of nonpeptide groups to peptides and proteins via periodate oxidation of a 2-Amino alcohol: application to modification at N-terminal serine, *Bioconj. Chem.*, 3:138-146 (1992).

Gibbs et al., "Farnesyltransferase inhibitors: Ras research yields a potential cancer therapeutic," *Cell*, 77:175-178 (1994).

Goodson et al., "High-affinity urokinase receptor antagonists identified with bacteriophage peptide display," *Proc. Natl. Acad. Sci.* (USA), 91:7129-7133 (1994).

Graf et al., "Delta-sleep-inducing peptide (DSIP): an update," *Peptides*, 7:1165-1187 (1986).

Greenwald et al., "Poly (ethylene glycol) conjugated drugs and prodrugs: A comprehensive review," *Crit. Rev. Therap. Drug Carrier Syst.*, 17:101-161 (2000).

Harris et al., "A novel process for modifying pharmacokinetics," *Clin. Pharmacokinet.*, 40(7):539-551 (2001).

Harwig et al., "Neutrophil Defensins: Purification, characterization, and antimicrobial testing," *Methods Enz.*, 236:160-172 (1994).

Harvill et al., "An IgG3-IL2 fusion protein activates complement, binds fcγRI, generates LAK activity and shows enhanced binding to the high affinity IL-2R," *Immunotech.*, 1:95-105 (1995).

Herz et al., "Molecular approaches to receptors as targets for drug discovery," *J. Receptor Signal Transduction Res.*, 17:671-776 (1997).

Hubbard et al., "Anti-neutrophil-elastase defenses of the lower respiratory tract in α1-Antitrypsin deficiency directly augmented with an aerosol of α1-antitrypsin," *Ann. Int. Med.*, 3:206-212 (1989).

Inagaki-Ohara et al., "Effects of a nonapeptide thymic hormone on intestinal intraepithelial lymphocytes in mice following administration of 5-fluorouracil[1]," *Cell. Immunol.*, 171:30-40 (1996).

Inglot et al., "Classification of cytokines according to the receptor code," *Arch. Immunol. Therap. Experimentals*, 45:353-357, (1997).

Ishikawa et al., "GD1α-replica peptides functionally mimic GD1α, an adhesion molecule of metastatic tumor cells, and suppress the tumor metastasis," *FEBS Letters*, 441: 20-24 (1998).

Katre et al., "Chemical modification of recombinant interleukin 2 by polyethylene glycol increases its potency in the murine meth A sarcoma model," *Proc. Natl. Acad. Sci.* (USA), 84:1487-1491 (1987).

Kay et al., "From peptides to drugs via phage display," *Drug Disc. Today*, 3:370-378 (1998).

King et al., "Hematoregulatory peptide, SK&F 107647, induced stromal cell production of KC (5-72) enhances CFU-GM growth and effector cell function," Abstract 1224, *Blood*, 86(Suppl. 1):309a (1995).

King et al., "Administration of an immunomodulatory azaspirane, SK&F 105685, or human recombinant interleukin 1 stimulates myelopoiesis and enhances survival from lethal irradiation in C57B1/6 mice," *Exp. Hematol.*, 19: 624-628 (1991).

Kitamura et al., "Adrenomedullin: A novel hypotensive peptide isolated from human pheochromocytoma," *Biochem. Biophys. Res. Comm.*, 192:553-560 (1993).

Koivunen et al., "Tumor targeting with a selective gelatinase inhibitor," *Nature Biotech.*, 17:768-774 (1999).

Kopecek et al., "Water soluble polymers in tumor targeted delivery," *J. Controlled Release*, 74:147-158 (2001).

Kraft et al., "Definition of an unexpected ligand recognition motif for αv β6 integrin," *J. Biol. Chem.*, 274:1979-1985 (1999).

Kreeger, "Immunological applications top list of peptide-synthesis services," *The Scientist*, 10:19-20 (1996).

Laerum et al., "The dimmer hemoregulatory peptide (HP5B) stimulates mouse and human myelopoiesis in vitro," *Exp. Hemat.*, 16:274-280 (1988).

Linse et al., "A region of vitamin K-dependent protein S that binds to C4b binding protein (C4BP) identified using bacteriophage peptide display libraries," *J. Biol. Chem.*, 272:14658-14665 (1997).

Linsley et al., "CTLA-4 is a second receptor for the B cell activation antigen B7," *J. Exp. Med.*, 174:561-569 (1991).

Livnah et al., "Functional mimicry of a protein hormone by a peptide agonist: the EPO receptor complex at 2.8 A," *Science*, 273:464-471 (1996).

Lowman et al., "Bacteriophage display and discovery of peptide leads for drug development," *Ann. Rev. Biophys. Biomol. Struct.*, 26:401-424 (1997).

Lundergan et al., "Angiotensin-II increases cytoplasmic calcium, cell number and total DNA for human periodontal ligamental cells in vitro," *J. Periodontal Res.*, 34:223-228 (1999).

Marshall, "Solid Oral Dosage Forms," *Modern Pharmaceutics*, edited by Banker and Rhodes, chapter 10, pp. 359-427 (1979).

Martens et al., "Peptides which bind to e-selection and block neutrophil adhesion," *J. Biol. Chem.*, 270:21129-21136 (1995).

Merrifield, "Solid-phase peptide synthesis," *Chem. Polypeptides*, 335-361 (1973).

Merrifield, "Solid phase peptide synthesis. I. the synthesis of a tetrapeptide[1]," *J. Am. Chem. Soc.*, 85:2149-2154 (1963).

Moodie et al., "The 3Rs of life: Ras, Raf and growth regulation," *Trends Genet.*, 10:44-48 (1994).

Moonga et al., "Effects of peptide fragments of protein kinase C on isolated rat osteoclasts," *Exp. Physiol*, 83: 717-725 (1998).

Morikis et al., "Solution structure of compstatin, a potent complement inhibitor," *Protein Science*, 7: 619-627 (1998).

Naranda et al., "Activation of erythropoietin receptor in the absence of hormone by a peptide that binds to a domain different from the hormone binding site," *Proc. Natl. Acad. Sci.* (USA), 96:7569-7574 (1999).

Nathan et al., "Copolymers of lysine and polyethylene glycol: A new family of functionalized drug carriers," *Bioconj. Chem.*, 4:54-62 (1993).

Nathan et al., "Hydrogels based on water-soluble poly(ether urethanes) derived from $_L$-Lysine and poly (ethylene glycol)," *Marcomolecules*, 25:4476-4484 (1992).

Newmark et al., "Preparation and properties of adducts of streptokinase and streptokinase-plasmin complex with polyethylene glycol and pluronic polyol F38," *J. Appl. Biochem.*, 4:185-189 (1982).

Park et al., "Rationally designed anti-HER2/neu peptide mimetic disables p185$^{HER2/neu}$ tyrosine kinases in vitro and in vivo," *Nat. Biotechnol.*, 18:194-198 (2000).

Paukovits et al., "Structural Investigations on a peptide regulating hemopoiesis in vitro and in vivo," *Physiol. Chem.*, 365:303-311 (1984).

Pawson et al., "SH2 and SH3 domains." *Curr. Biol.*, 3:434-442 (1993).

Picksley et al., "Immunochemical analysis of the interaction of p53 with MDM2—fine mapping of the MDM2 binding site on p53 using synthetic peptides," *Oncogene*, 9:2523-2529 (1994).

Pierce et al., "Identification of cyclized calmodulin antagonists from a phage display random peptide library," *Molec. Diversity*, 1:259-265 (1995).

Rickles et al., Identification of Src, Fyn, Lyn, PI3K and Abl SH3 domain ligands using phage display libraries, *EMBO J.*, 13:5598-5604 (1994).

Roberts et al., "RNA-peptide fusions for the in vitro selection of peptides and proteins," *Proc. Natl. Acad. Sci.* (USA), 94:12297-12303 (1997).

Rodriguez et al., "Phosphatidylinositol-3-OH kinase as direct a direct target of Ras," *Nature*, 370:527-532 (1994).

Sahu et al., "Inhibition of human complement by a C3-binding peptide isolated from a phage—displayed random peptide library[1]," *J. Immunol.*, 157:884-891 (1996).

Sarmay et al., "Mapping and comparison of the interaction sites on the Fc region of IgG responsible for triggering antibody dependent cellular cytotoxicity (ADCC) through different types of human Fcγreceptor," *Molec. Immunol.*, 29:633-639 (1992).

Scott et al., "Searching for peptide ligands with an epitope library," *Science*, 249:386-390 (1990).

Smith et al., "Pulmonary deposition and clearance of aerosolized alpha-1-Proteinase inhibitor administered to dogs and to sheep," *J. Clin. Invest.*, 84:1145-1154 (1989).

Smith et al., "Isolation of glucagon antagonists by random molecular mutagenesis and screening," *Mol. Pharmacol.*, 43:741-748 (1993).

Sparks et al., "Identification and characterization of Src SH3 ligands from phage-displayed random peptide libraries," *J. Biol. Chem.*, 269:23853-23856 (1994).

Sparks et al., "Distinct ligand preferences of Src homology 3 domains from Src, Yes, Abl, cortactin, p53bp2, PLCγ, Crk, and Grb2," *Proc. Natl. Acad. Sci.* (USA), 93:1540-1544 (1996).

Stauffer et al., "Inhibition of lyn function in mast cell activation by SH3 domain binding peptides," *Biochem.*, 36:9388-9394 (1997).

Suzuki et al., Physicochemical and biological properties of poly(ethylene glycol)-coupled immunoglobulin G, *Biochem. Biophys. Acta*, 788:248-255 (1984).

Suzuki et al., "The relationship between amino acid sequences of sperm-activating peptides and the taxonomy of echinoids," *Comp. Biochem. Physiol.*, 102B:679-690 (1992).

Takasaki et al., "Structure-based design and characterization of exocyclic peptidomimetics that inhibit TNFα binding to its receptor," *Nature Biotech.*, 15:1266-1270 (1997).

Van Zee et al., "Protection against lethal *Escherichia coli* bacteremia in baboons (papio anubis) by pretreatment with a 55-kDa TNF receptor (CD120a)-Ig fusion protein, Ro 45-2081[1]," *J. Immunol.* 156:2221-2230 (1996).

Veronese et al., "Surface modification of proteins," *Biochem. Biotech.*, 11:141-152 (1985).

Wells et al., "Rapid evolution of peptide and protein binding properties in vitro," *Curr. Opin. Biotechnol.*, 3:355-362 (1992).

Wieczorek et al., "A hexapeptide VTKFYF from C-terminal part of interleukin-1 receptor antagonist, an inhibitor of IL-1-IL-1 receptor interaction," *Pol. J. Pharmacol.*, 49:107-117 (1997).

Wilson et al., "Phage display: applications, innovations, and issues in phage and host biology," *Can. J. Microbiol.*, 44:313-329 (1998).

Wrighton et al., "Increased potency of an erythropoietin peptide mimetic through covalent dimerization," *Nat. Biotechnol.*, 15:1261-1265 (1997).

Wrighton et al., "Small peptides as potent mimetics of the protein hormone erythropoietin," *Science*, 273:458-463 (1996).

Yanofsky et al., "High affinity type I interleukin 1 receptor antagonists discovered by screening recombinant peptide libraries," *Proc. Natl. Acad. Sci.* (USA), 93:7381-7386 (1996).

Yoshida et al., "The activity of synthetic analogs of serum thymic factor (FTS) to convert mouse pre-T cells into THY-1 positive cells," *Int. J. Immunol.*, 6:141-146 (1984).

Yu et al., "Structural basis for the binding of praline-rich peptides to SH3 domains," *Cell*, 76:933-945 (1994).

Zalipsky et al., "Poly(ethylene glycol)- grafted liposomes with oligopeptide or oligiosaccharide ligands appended to the termini of the polymer chains," *Bioconj. Chem.*, 8:111-118 (1997).

Zheng et al., "Administration of nocytolytic IL-10/Fc in murine models of lipopolysaccharide—induced septic shock and allogeneic islet transplantation," *J. Immunol.* 154:5590-5600 (1995).

* cited by examiner

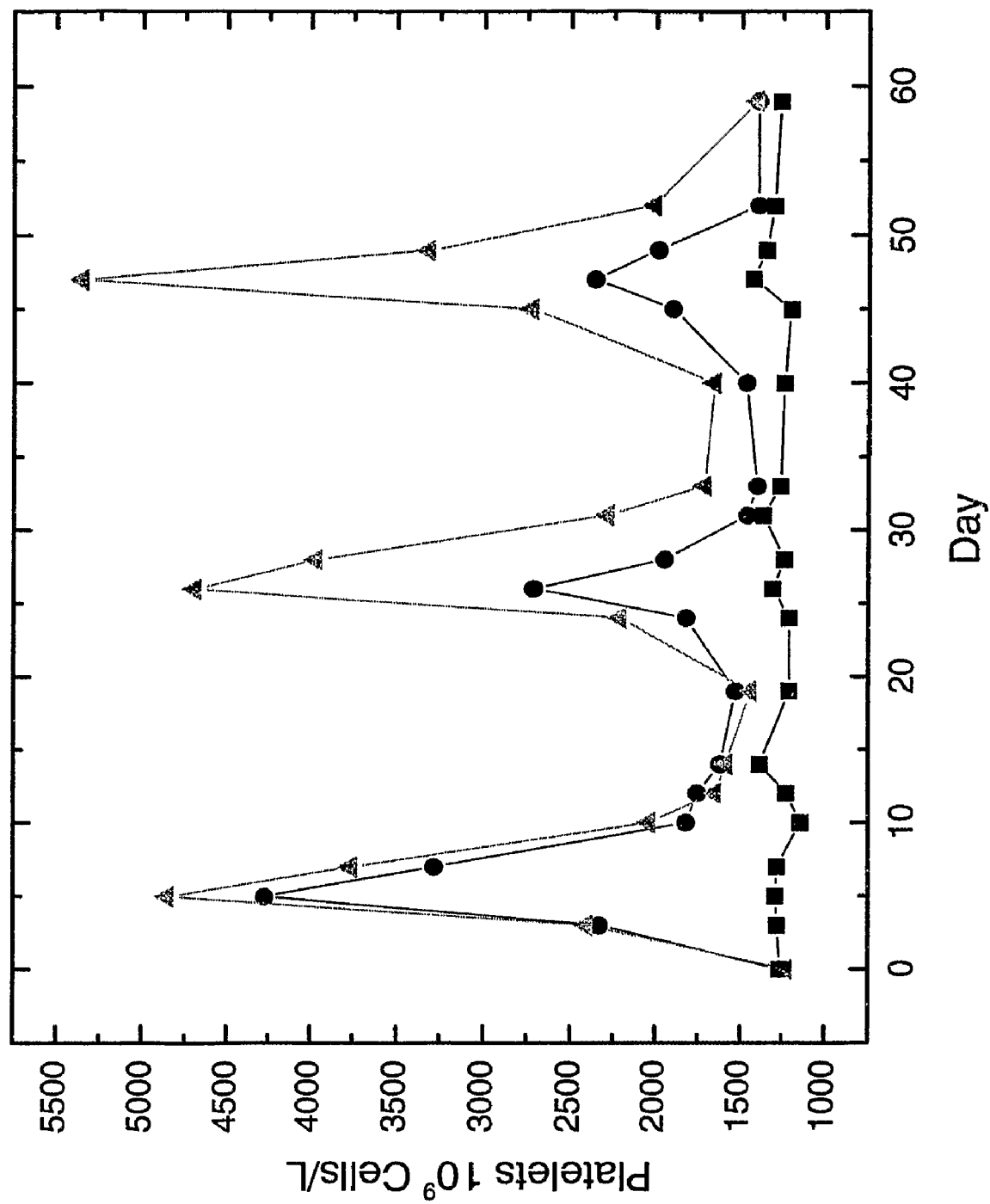

THERAPEUTIC PEPTIDES

This application was filed as a U.S. National Phase Application pursuant to 35 U.S.C. §371 of International Application No. PCT/US05/24373 which was filed Jul. 8, 2005, which in turn claims benefit under 35 U.S.C. §119 of U.S. Application Ser. No. 60/586,419, which was filed Jul. 8, 2004. The entire disclosure of each of the foregoing applications is incorporated herein by reference in its entirety.

FIELD OF THE INVENTION

Generally, the invention relates to compounds that exhibit improved bioefficacy in multidose administration. More specifically, the invention relates to polypeptides or peptides modified to include an antibody Fc region and one or more water soluble polymers.

BACKGROUND OF THE INVENTION

Recombinant proteins are an emerging class of therapeutic agents. Such recombinant therapeutics have engendered advances in protein formulation and chemical modification. Modifications have been identified that can protect therapeutic proteins, primarily by blocking their exposure to proteolytic enzymes. Protein modifications may also increase the therapeutic protein's stability, circulation time, and biological activity. A review article describing protein modification and fusion proteins is Francis (1992), Focus on Growth Factors 3:4-10 (Mediscript, London), which is hereby incorporated by reference.

One useful modification is combination of a polypeptide with an "Fc" domain of an antibody. Antibodies comprise two functionally independent parts, a variable domain known as "Fab," which binds antigen, and a constant domain known as "Fc," which links to such effector functions as complement activation and attack by phagocytic cells. An Fc has a long serum half-life, whereas an Fab is short-lived. Capon et al. (1989), Nature 337: 525-31. When constructed together with a therapeutic protein, an Fc domain can provide longer half-life or incorporate such functions as Fc receptor binding, protein A binding, complement fixation and perhaps even placental transfer. Id. Table 1 summarizes use of Fc fusions known in the art.

TABLE 1

Fc fusion with therapeutic proteins

| Form of Fc | Fusion partner | Therapeutic implications | Reference |
|---|---|---|---|
| IgG1 | N-terminus of CD30-L | Hodgkin's disease; anaplastic lymphoma; T-cell leukemia | U.S. Pat. No. 5,480,981 |
| Murine Fcγ2a | IL-10 | anti-inflammatory; transplant rejection | Zheng et al. (1995), J. Immunol. 154: 5590-600 |
| IgG1 | TNF receptor | septic shock | Fisher et al. (1996), N. Engl. J. Med. 334: 1697-1702; Van Zee, K. et al. (1996). J. Immunol. 156: 2221-30 |
| IgG, IgA, IgM, or IgE (excluding the first domain) | TNF receptor | inflammation, autoimmune disorders | U.S. Pat. No. 5,808,029, issued Sep. 15, 1998 |
| IgG1 | CD4 receptor | AIDS | Capon et al. (1989), Nature 337: 525-31 |
| IgG1, IgG3 | N-terminus of IL-2 | anti-cancer, antiviral | Harvill et al. (1995), Immunotech. 1: 95-105 |
| IgG1 | C-terminus of OPG | osteoarthritis; bone density | WO 97/23614, published Jul. 3, 1997 |
| IgG1 | N-terminus of leptin | anti-obesity | PCT/US 97/23183, filed Dec. 11, 1997 |
| Human Ig Cγ1 | CTLA-4 | autoimmune disorders | Linsley (1991), J. Exp. Med. 174: 561-9 |

Polyethylene glycol ("PEG") fusion proteins and peptides have also been studied for use in pharmaceuticals, on artificial implants, and other applications where biocompatibility is of importance. Various derivatives of PEG have been proposed that have an active moiety for permitting PEG to be attached to pharmaceuticals and implants and to molecules and surfaces generally. For example, PEG derivatives have been proposed for coupling PEG to surfaces to control wetting, static buildup, and attachment of other types of molecules to the surface, including proteins or protein residues.

In other studies, coupling of PEG ("PEGylation") has been shown to be desirable in overcoming obstacles encountered in clinical use of biologically active molecules. Published PCT Publication No. WO 92/16221 states, for example, that many potentially therapeutic proteins have been found to have a short half life in blood serum.

PEGylation decreases the rate of clearance from the bloodstream by increasing the apparent molecular weight of the molecule. Up to a certain size, the rate of glomerular filtration of proteins is inversely proportional to the size of the protein. The ability of PEGylation to decrease clearance, therefore, is generally not a function of how many PEG groups are attached to the protein, but the overall molecular weight of the altered protein. Decreased clearance can lead to increased efficacy over the non-PEGylated material. See, for example, Conforti et al., Pharm. Research Commun. vol. 19, pg. 287 (1987) and Katre et., Proc. Natl. Acad. Sci. U.S.A. vol. 84, pg. 1487 (1987).

In addition, PEGylation can decrease protein aggregation, (Suzuki et al., Biochem. Biophys. Acta vol. 788, pg. 248 (1984)), alter protein immunogenicity (Abuchowski et al., J.

Biol. Chem. vol. 252 pg. 3582 (1977)), and increase protein solubility as described, for example, in PCT Publication No. WO 92/16221.

PEGylation of proteins illustrates some of the problems that have been encountered in attaching PEG to surfaces and molecules. The vast majority of PEGylating reagents react with free primary amino groups of the polypeptide. Most of these free amines are the epsilon amino group of lysine amino acid residues. Typical proteins possess a large number of lysines. Consequently, random attachment of multiple PEG molecules often occurs leading to loss of protein activity.

In addition, if the PEGylated protein is intended for therapeutic use, the multiple species mixture that results from the use of non-specific PEGylation leads to difficulties in the preparation of a product with reproducible and characterizable properties. This non-specific PEGylation makes it difficult to evaluate therapeutics and to establish efficacy and dosing information. Site selective PEGylation of such proteins, however, leads to reproducibly-modified materials that gain the desirable attributes of PEGylation without the loss of activity.

A variety of means have been used to attach the polyethylene glycol molecules to the protein. Amino groups, such as those on lysine residues or at the N-terminus, are convenient for such attachment. For example, Royer (U.S. Pat. No. 4,002,531, incorporated herein by reference in its entirety) states that reductive alkylation was used for attachment of polyethylene glycol molecules to an enzyme. EP 0 539 167 (incorporated herein by reference in its entirety), published Apr. 28, 1993, Wright, "Peg Imidates and Protein Derivates Thereof" states that peptides and organic compounds with free amino group(s) are modified with a derivative of PEG or related water-soluble organic polymers. U.S. Pat. No. 4,904,584 (incorporated herein by reference in its entirety), Shaw, issued Feb. 27, 1990, relates to the modification of lysine residues in proteins for the attachment of polyethylene glycol molecules via reactive amine groups. An increasing number of therapeutic proteins modified in the manner described above to include PEG have been previously described. See also, for example, European patent application publications EP 0 401 384; EP 0 473 268; EP 0 335 423; EP 0 442 724; EP 0 154 316, each of which is incorporated by reference in its entirety.

Other methods for attaching a polymer to a protein involve using a moiety to act as a linking group. Such moieties may, however, be antigenic. A tresyl chloride method involving no linking group is available, but this method may be difficult to use to produce therapeutic products as the use of tresyl chloride may produce toxic by-products. See Francis et al., In: Stability of protein pharmaceuticals: in vivo pathways of degradation and strategies for protein stabilization (Eds. Ahern., T. and Manning, M. C.) Plenum, N.Y., 1991) and Delgado et al., "Coupling of PEG to Protein By Activation With Tresyl Chloride, Applications In Immunoaffinity Cell Preparation", In: Fisher et al., eds., Separations Using Aqueous Phase Systems, Applications In Cell Biology and Biotechnology, Plenum Press, N.Y. N.Y., 1989 pp. 211-213, each of which is incorporated by reference in its entirety.

In general, the interaction of a protein ligand with its receptor often takes place at a relatively large interface. However, as demonstrated in the case of human growth hormone bound to its receptor, only a few key residues at the interface actually contribute to most of the binding energy. Clackson, T. et al., Science 267:383-386 (1995). This observation and the fact that the bulk of the remaining protein ligand serves only to display the binding epitopes in the right topology makes it possible to find active ligands of much smaller size. Thus, molecules of only "peptide" length (2 to 40 amino acids) can bind to the receptor protein of a given large protein ligand. Such peptides may mimic the bioactivity of the large protein ligand ("peptide agonists") or, through competitive binding, inhibit the bioactivity of the large protein ligand ("peptide antagonists").

Phage display peptide libraries have emerged as a powerful method in identifying such peptide agonists and antagonists. See, for example, Scott et al. (1990), Science 249: 386; Devlin et al. (1990), Science 249: 404; U.S. Pat. No. 5,223,409, issued Jun. 29, 1993; U.S. Pat. No. 5,733,731, issued Mar. 31, 1998; U.S. Pat. No. 5,498,530, issued Mar. 12, 1996; U.S. Pat. No. 5,432,018, issued Jul. 11, 1995; U.S. Pat. No. 5,338,665, issued Aug. 16, 1994; U.S. Pat. No. 5,922,545, issued Jul. 13, 1999; WO 96/40987, published Dec. 19, 1996; and WO 98/15833, published Apr. 16, 1998, each of which is incorporated by reference. In such libraries, random peptide sequences are displayed by fusion with coat proteins of filamentous phage. Typically, the displayed peptides are affinity-eluted against an antibody-immobilized extracellular domain of a receptor. The retained phages may be enriched by successive rounds of affinity purification and repropagation, and the best binding peptides are sequenced to identify key residues within one or more structurally related families of peptides. See, e.g., Cwirla et al. (1997), Science 276: 1696-9, in which two distinct families were identified. The peptide sequences may also suggest which residues may be safely replaced by alanine scanning or by mutagenesis at the DNA level. Mutagenesis libraries may be created and screened to further optimize the sequence of the best binders. Lowman (1997), Ann. Rev. Biophys. Biomol. Struct. 26: 401-24.

Other methods compete with phage display in peptide research. A peptide library can be fused to the carboxyl terminus of the lac repressor and expressed in *E. coli*. Another *E. coli*-based method allows display on the cell's outer membrane by fusion with a peptidoglycan-associated lipoprotein (PAL). These and related methods are collectively referred to as "*E. coli* display." Another biological approach to screening soluble peptide mixtures uses yeast for expression and secretion. See Smith et al. (1993), Mol. Pharmacol. 43: 741-8. The method of Smith et al. and related methods are referred to as "yeast-based screening." In another method, translation of random RNA is halted prior to ribosome release, resulting in a library of polypeptides with their associated RNA still attached. This and related methods are collectively referred to as "ribosome display." Other methods employ chemical linkage of peptides to RNA; see, for example, Roberts & Szostak (1997), Proc. Natl. Acad. Sci. USA, 94: 12297-303. This and related methods are collectively referred to as "RNA-peptide screening." Chemically derived peptide libraries have been developed in which peptides are immobilized on stable, non-biological materials, such as polyethylene rods or solvent-permeable resins. Another chemically derived peptide library uses photolithography to scan peptides immobilized on glass slides. These and related methods are collectively referred to as "chemical-peptide screening." Chemical-peptide screening may be advantageous in that it allows use of D-amino acids and other unnatural analogues, as well as non-peptide elements. Both biological and chemical methods are reviewed in Wells & Lowman (1992), Curr. Opin. Biotechnol. 3: 355-62.

In the case of known bioactive peptides, rational design of peptide ligands with favorable therapeutic properties can be carried out. In such an approach, stepwise changes are made to a peptide sequence and the effect of the substitution upon bioactivity or a predictive biophysical property of the peptide (e.g., solution structure) is determined. These techniques are collectively referred to as "rational design." In one such technique, a series of peptides is made in which a single residue at a time is replaced with alanine. This technique is commonly referred to as an "alanine walk" or an "alanine scan." When two residues (contiguous or spaced apart) are replaced, it is referred to as a "double alanine walk." The resultant amino acid substitutions can be used alone or in combination to result in a new peptide entity with favorable therapeutic properties.

Structural analysis of protein-protein interaction may also be used to suggest peptides that mimic the binding activity of large protein ligands. In such an analysis, the crystal structure may suggest the identity and relative orientation of critical residues of the large protein ligand, from which a peptide may be designed. See, e.g., Takasaki et al. (1997), Nature Biotech. 15: 1266-70. These and related methods are referred to as "protein structural analysis." These analytical methods may also be used to investigate the interaction between a receptor protein and peptides selected by phage display, which may suggest further modification of the peptides to increase binding affinity.

Conceptually, peptide mimetics of any protein can be identified using phage display and the other methods mentioned above. These methods have also been used for epitope mapping, for identification of critical amino acids in protein-protein interactions, and as leads for the discovery of new therapeutic agents. E.g., Cortese et al. (1996), Curr. Opin. Biotech. 7: 616-21. Peptide libraries are now being used most often in immunological studies, such as epitope mapping. Kreeger (1996), The Scientist 10(13): 19-20.

Of particular interest is use of peptide libraries and other techniques in the discovery of pharmacologically active peptides. A number of such peptides identified in the art are summarized in Table 2. The peptides are described in the listed publications, each of which is hereby incorporated by reference. The pharmacologic activity of the peptides is described, and in many instances is followed by a shorthand term therefor in parentheses. Some of these peptides have been modified (e.g., to form C-terminally cross-linked dimers). Typically, peptide libraries were screened for binding to a receptor for a pharmacologically active protein (e.g., EPO receptor). In at least one instance (CTLA4), the peptide library was screened for binding to a monoclonal antibody.

TABLE 2

Pharmacologically active peptides

| Form of peptide | Binding partner/ protein of interest[1] | Pharmacologic activity | Reference |
| --- | --- | --- | --- |
| intrapeptide disulfide-bonded | EPO receptor | EPO-mimetic | Wrighton et al. (1996), Science 273: 458-63; U.S. Pat. No. 5,773,569, issued Jun. 30, 1998 to Wrighton et al. |
| C-terminally cross-linked dimer | EPO receptor | EPO-mimetic | Livnah et al. (1996), Science 273: 464-71; Wrighton et al. (1997), Nature Biotechnology 15: 1261-5; International patent application WO 96/40772, published Dec. 19, 1996 |
| linear | EPO receptor | EPO-mimetic | Naranda et al. (1999), Proc. Natl. Acad. Sci. USA, 96: 7569-74; WO 99/47151, published Sep. 23, 1999 |
| linear | c-Mpl | TPO-mimetic | Cwirla et al.(1997) Science 276: 1696-9; U.S. Pat. No. 5,869,451, issued Feb. 9, 1999; U.S. Pat. No. 5,932,946, issued Aug. 3, 1999 |
| C-terminally cross-linked dimer | c-Mpl | TPO-mimetic | Cwirla et al. (1997), Science 276: 1696-9 |
| disulfide-linked dimer | | stimulation of hematopoiesis ("G-CSF-mimetic") | Paukovits et al. (1984), Hoppe-Seylers Z. Physiol. Chem. 365: 303-11; Laerum et al. (1988), Exp. Hemat. 16: 274-80 |
| alkylene-linked dimer | | G-CSF-mimetic | Bhatnagar et al. (1996), J. Med. Chem. 39: 3814-9; Cuthbertson et al. (1997), J. Med. Chem. 40: 2876-82; King et al. (1991), Exp. Hematol. 19: 481; King et al. (1995), Blood 86 (Suppl. 1): 309a |
| linear | IL-1 receptor | inflammatory and autoimmune diseases ("IL-1 antagonist" or "IL-1ra-mimetic") | U.S. Pat. No. 5,608,035; U.S. Pat. No. 5,786,331; U.S. Pat. No. 5,880,096; Yanofsky et al. (1996). Proc. Natl. Acad. Sci. 93: 7381-6; Akeson et al. (1996), J. Biol. Chem. 271: |

TABLE 2-continued

Pharmacologically active peptides

| Form of peptide | Binding partner/ protein of interest[1] | Pharmacologic activity | Reference |
|---|---|---|---|
| | | | 30517-23; Wiekzorek et al. (1997), *Pol. J. Pharmacol.* 49: 107-17; Yanofsky (1996), PNAs, 93: 7381-7386. |
| linear | Facteur thymique serique (FTS) | stimulation of lymphocytes ("FTS-mimetic") | Inagaki-Ohara et al. (1996), *Cellular Immunol.* 171: 30-40; Yoshida (1984), *Int. J. Immunopharmacol*, 6: 141-6. |
| intrapeptide disulfide bonded exocyclic | CTLA4 MAb | CTLA4-mimetic | Fukumoto et al. (1998), *Nature Biotech.* 16: 267-70 |
| | TNF-α receptor | TNF-α antagonist | Takasaki et al. (1997), *Nature Biotech.* 15: 1266-70; WO 98/53842, published Dec. 3, 1998 |
| linear | TNF-α receptor | TNF-α antagonist | Chirinos-Rojas ( ), *J. Imm.*, 5621-5626. |
| intrapeptide disulfide bonded | C3b | inhibition of complement activation; autoimmune diseases ("C3b-antagonist") | Sahu et al. (1996), *J. Immunol.* 157: 884-91; Morikis et al. (1998), *Protein Sci.* 7: 619-27 |
| linear | vinculin | cell adhesion processes-cell growth, differentiation, wound healing, tumor metastasis ("vinculin binding") | Adey et al. (1997). *Biochem. J.* 324: 523-8 |
| linear | C4 binding protein (C4BP) | anti-thrombotic | Linse et al. (1997), *J. Biol. Chem.* 272: 14658-65 |
| linear | urokinase receptor | processes associated with urokinase interaction with its receptor (e.g., angiogenesis, tumor cell invasion and metastasis); ("UKR antagonist") | Goodson et al. (1994), *Proc. Natl. Acad. Sci.* 91: 7129-33; International application WO 97/35969, published Oct. 2, 1997 |
| linear | Mdm2, Hdm2 | Inhibition of inactivation of p53 mediated by Mdm2 or hdm2; anti-tumor ("Mdm/hdm antagonist") | Picksley et al. (1994), *Oncogene* 9: 2523-9; Bottger et al. (1997) *J. Mol. Biol.* 269: 744-56; Bottger et al. (1996), *Oncogene* 13: 2141-7 |
| linear | $p21^{WAF1}$ | anti-tumor by mimicking the activity of $p21^{WAF1}$ | Ball et al. (1997), *Curr. Biol.* 7: 71-80 |
| linear | farnesyl transferase | anti-cancer by preventing activation of ras oncogene | Gibbs et al. (1994), *Cell* 77: 175-178 |
| linear | Ras effector domain | anti-cancer by inhibiting biological function of the ras oncogene | Moodie et al. (1994), *Trends Genet* 10: 44-48 Rodriguez et al. (1994), *Nature* 370: 527-532 |
| linear | SH2/SH3 domains | anti-cancer by inhibiting tumor growth with activated tyrosine kinases; treatment of SH3-mediated disease states ("SH3 antagonist") | Pawson et al (1993), *Curr. Biol.* 3: 434-432 Yu et al. (1994), *Cell* 76: 933-945; Rickles et al. (1994), *EMBO J.* 13: 5598-5604; Sparks et al. (1994), *J. Biol. Chem.* 269: 23853-6; Sparks et al. (1996), *Proc. Natl. Acad. Sci.* 93: 1540-4; U.S. Pat. No. 5,886,150, issued Mar. 23, 1999; U.S. Pat. No. 5,888,763, issued Mar. 30, 1999 |
| linear | $p16^{INK4}$ | anti-cancer by mimicking activity of p16; e.g., inhibiting cyclin D-Cdk complex ("p16-mimetic") | Fåhraeus et al. (1996), *Curr. Biol.* 6: 84-91 |
| linear | Src, Lyn | inhibition of Mast cell activation, IgE-related conditions, type I hypersensitivity ("Mast cell antagonist") | Stauffer et al. (1997), *Biochem.* 36: 9388-94 |

TABLE 2-continued

Pharmacologically active peptides

| Form of peptide | Binding partner/ protein of interest[1] | Pharmacologic activity | Reference |
|---|---|---|---|
| linear | Mast cell protease | treatment of inflammatory disorders mediated by release of tryptase-6 ("Mast cell protease inhibitors") | International application WO 98/33812, published Aug. 6, 1998 |
| linear | HBV core antigen (HBcAg) | treatment of HBV viral infections ("anti-HBV") | Dyson & Muray (1995), *Proc. Natl. Acad. Sci.* 92: 2194-8 |
| linear | selectins | neutrophil adhesion; inflammatory diseases ("selectin antagonist") | Martens et al. (1995), *J. Biol. Chem.* 270: 21129-36; European patent application EP 0 714 912, published Jun. 5, 1996 |
| linear, cyclized | calmodulin | calmodulin antagonist | Pierce et al. (1995), *Molec. Diversity* 1: 259-65; Dedman et al. (1993), *J. Biol. Chem.* 268: 23025-30; Adey & Kay (1996), *Gene* 169: 133-4 |
| linear, cyclized- | integrins | tumor-homing; treatment for conditions related to integrin-mediated cellular events, including platelet aggregation, thrombosis, wound healing, osteoporosis, tissue repair, angiogenesis (e.g., for treatment of cancer), and tumor invasion ("integrin-binding") | International applications WO 95/14714, published Jun. 1, 1995; WO 97/08203, published Mar. 6, 1997; WO 98/10795, published Mar. 19, 1998; WO 99/24462, published May 20, 1999; Kraft et al. (1999), *J. Biol. Chem.* 274: 1979-1985 |
| cyclic, linear | fibronectin and extracellular matrix components of T cells and macrophages | treatment of inflammatory and autoimmune conditions | WO 98/09985, published Mar. 12, 1998 |
| linear | somatostatin and cortistatin | treatment or prevention of hormone-producing tumors, acromegaly, giantism, dementia, gastric ulcer, tumor growth, inhibition of hormone secretion, modulation of sleep or neural activity | European patent application 0 911 393, published Apr. 28, 1999 |
| linear | bacterial lipopolysaccharide | antibiotic; septic shock; disorders modulatable by CAP37 | U.S. Pat. No. 5,877,151, issued Mar. 2, 1999 |
| linear or cyclic, including D-amino acids | pardaxin, mellitin | antipathogenic | WO 97/31019, published 28 Aug. 1997 |
| linear, cyclic | VIP | impotence, neurodegenerative disorders | WO 97/40070, published Oct. 30, 1997 |
| linear | CTLs | cancer | EP 0 770 624, published May 2, 1997 |
| linear | THF-gamma2 | | Burnstein (1988), *Biochem.*, 27: 4066-71. |
| linear | Amylin | | Cooper (1987), *Proc. Natl. Acad. Sci.*, 84: 8628-32. |
| linear | Adrenomedullin | | Kitamura (1993), *BBRC*, 192: 553-60. |
| cyclic, linear | VEGF | anti-angiogenic; cancer, rheumatoid arthritis, diabetic retinopathy, psoriasis ("VEGF antagonist") | Fairbrother (1998), *Biochem.*, 37: 17754-17764. |
| cyclic | MMP | inflammation and autoimmune disorders; tumor growth ("MMP inhibitor") | Koivunen (1999), *Nature Biotech.*, 17: 768-774. |
| | HGH fragment | treatment of obesity | U.S. Pat. No. 5,869,452 |
| | Echistatin | inhibition of platelet aggregation | Gan (1988). *J. Biol. Chem.*, 263: 19827-32. |

TABLE 2-continued

Pharmacologically active peptides

| Form of peptide | Binding partner/ protein of interest[1] | Pharmacologic activity | Reference |
|---|---|---|---|
| linear | SLE autoantibody | SLE | WO 96/30057, published Oct. 3, 1996 |
| | GD1alpha | suppression of tumor metastasis | Ishikawa et al. (1998), FEBS Lett. 441 (1): 20-4 |
| | antiphospholipid beta-2-glycoprotein-I ($\beta$2GPI) antibodies | endothelial cell activation, antiphospholipid syndrome (APS), thromboembolic phenomena, thrombocytopenia, and recurrent fetal loss | Blank et al. (1999), Proc. Natl. Acad. Sci. USA 96: 5164-8 |
| linear | T Cell Receptor beta chain | diabetes | WO 96/11214, published Apr. 18, 1996. |
| | | Antiproliferative, antiviral | WO 00/01402, published Jan. 13, 2000. |
| | | anti-ischemic, growth hormone-liberating | WO 99/62539, published Dec. 9, 1999. |
| | | anti-angiogenic | WO 99/61476, published Dec. 2, 1999. |
| linear | | Apoptosis agonist; treatment of T cell-associated disorders (e.g., autoimmune diseases, viral infection, T cell leukemia, T cell lymphoma) | WO 99/38526, published Aug. 5, 1999. |
| linear | MHC class II | treatment of autoimmune diseases | U.S. Pat. No. 5,880,103, issued Mar. 9, 1999. |
| linear | androgen R, p75, MJD, DCC, huntingtin | proapoptotic, useful in treating cancer | WO 99/45944, published Sep. 16, 1999. |
| linear | von Willebrand Factor; Factor VIII | inhibition of Factor VIII interaction; anticoagulants | WO 97/41220, published Apr. 29, 1997, |
| linear | lentivirus LLP1 | antimicrobial | U.S. Pat. No. 5,945,507, issued Aug. 31, 1999. |
| linear | Delta-Sleep Inducing Peptide | sleep disorders | Graf (1986), Peptides 7: 1165. |
| linear | C-Reactive Protein (CRP) | inflammation and cancer | Barna (1994), Cancer Immunol. Immunother. 38: 38 (1994). |
| linear | Sperm-Activating Peptides | infertility | Suzuki (1992), Comp. Biochem. Physiol. 102B: 679. |
| linear | angiotensins | hematopoietic factors for hematocytopenic conditions from cancer, AIDS, etc. | Lundergan (1999), J. Periodontal Res. 34(4): 223-228. |
| linear | HIV-1 gp41 | anti-AIDS | Chan (1998), Cell 93: 681-684. |
| linear | PKC | inhibition of bone resorption | Moonga (1998), Exp. Physiol. 83: 717-725. |
| linear | defensins (HNP-1, -2, -3, -4) | antimicrobial | Harvig (1994), Methods Enz. 236: 160-172. |
| linear | p185$^{HER2/neu}$, C-erbB-2 | AHNP-mimetic: anti-tumor | Park (2000), Nat. Biotechnol. 18: 194-198. |
| linear | gp130 | IL-6 antagonist | WO 99/60013, published Nov. 25, 1999. |
| linear | collagen, other joint, cartilage, arthritis-related proteins | autoimmune diseases | WO 99/50282, published Oct. 7, 1999. |
| linear | HIV-1 envelope protein | treatment of neurological degenerative diseases | WO 99/51254, published Oct. 14, 1999. |
| linear | IL-2 | autoimmune disorders (e.g., graft rejection, rheumatoid arthritis) | WO 00/04048, published Jan. 27, 2000; WO 00/11028, published Mar. 2, 2000. |

[1]The protein listed in this column may be bound by the associated peptide (e.g., EPO receptor, IL-1 receptor) or mimicked by the associated peptide. The references listed for each clarify whether the molecule is bound by or mimicked by the peptides.

Peptides identified by peptide library screening have been regarded as "leads" in development of therapeutic agents rather than being used as therapeutic agents themselves. Like other proteins and peptides, they would be rapidly removed in vivo either by renal filtration, cellular clearance mechanisms in the reticuloendothelial system, or proteolytic degradation. Francis (1992), Focus on Growth Factors 3: 4-11. As a result, the art presently uses the identified peptides to validate drug targets or as scaffolds for design of organic compounds that might not have been as easily or as quickly identified through chemical library screening. Lowman (1997), Ann. Rev. Biophys. Biomol. Struct. 26: 401-24; Kay et al. (1998), Drug Disc. Today 3: 370-8.

In spite of the availability of recombinant therapeutic proteins, previously identified peptide mimetic, and modifications thereof, there thus remains a need in the art to provide additional compounds that have improved bioefficacy, particularly when administered in a multidose regimen.

SUMMARY OF THE INVENTION

The present invention relates to polypeptides or peptides modified to include an antibody Fc region and one or more water soluble polymers.

In one aspect, a substantially homogenous compound is provided comprising a structure set out in Formula I, $$[(X^1)_a—F^1—(X^2)_b]-(L^1)_c-WSP_d \qquad \text{Formula I}$$

wherein:
$F^1$ is a vehicle;
$X^1$ is selected from
$P^1-(L^2)_e—$
$P^2-(L^3)_f-P^1-(L^2)_e—$
$P^4-(L^4)_g-P^2-(L^3)_f-P^1-(L^2)_e$- and
$P^4-(L^5)_h-P^3-(L^4)_g-P^2-(L^3)_f-P^1-(L^2)_e$-
$X^2$ is selected from:
$-(L^2)_e-P^1$,
$-(L^2)_e-P^1-(L^3)_f-P^2$,
$-(L^2)_e-P^1-(L^3)_f-P^2-(L^4)_g-P^3$, and
$-(L^2)_e-P^1-(L^3)_f-P^2-(L^4)_g-P^3-(L^5)_h-P^4$
wherein $P^1$, $P^2$, $P^3$, and $P^4$ are each independently sequences of pharmacologically active peptides;
$L^1$, $L^2$, $L^3$, $L^4$, and $L^5$ are each independently linkers;
a, b, c, e, f, g, and h are each independently 0 or 1,
provided that at least one of a and b is 1;
d is at least 1; and
WSP is a water soluble polymer, the attachment of which is effected at any reactive moiety in $F^1$;

said compound having a property of improved bioefficacy when administered in a multidose regimen. In one aspect, the compound a multimer, and in another aspect, the compound is a dimer.

In one embodiment, the invention provides a compound of Formula I comprising a structure set out in Formula II $$[X^1—F^1]-(L^1)_c-WSP_d \qquad \text{Formula II}$$

wherein $F^1$ is an Fc domain and is attached at the C-terminus of $X^1$, and one or more WSP is attached to the Fc domain, optionally through linker $L^1$. Compounds having this structure are provided as a multimer in one aspect and a dimer in another aspect.

In another embodiment, the invention provides a compound of Formula I comprising a structure set out in Formula III $$[F^1—X^2]-(L^1)_c-WSP_d \qquad \text{Formula III}$$

wherein $F^1$ is an Fc domain and is attached at the N-terminus of $X^2$, and one or more WSP is attached to the Fc domain, optionally through linker $L^1$. Multimers and dimers of a compound having this structure are also provided.

The invention also provides a compound of Formula I comprising a structure set out in Formula IV $$[F^1-(L^2)_e-P^1]-(L^1)_c-WSP_d \qquad \text{Formula IV}$$

wherein $F^1$ is an Fc domain and is attached at the N-terminus of $-(L^1)_c-P^1$ and one or more WSP is attached to the Fc domain, optionally through linker $L^1$. Multimers and dimers of a compound having this structure are also provided.

The invention further contemplates a compound of Formula I comprising a structure set out in Formula V $$[F^1-(L^2)_e-P^1-(L^3)_f-P^2]-(L^1)_c-WSP_d \qquad \text{Formula V}$$

wherein $F^1$ is an Fc domain and is attached at the N-terminus of $-L^2-P^1-L^3-P^2$ and one or more WSP is attached to the Fc domain, optionally through linker $L^1$. Multimers and dimers of a compound having this structure are also provided.

In one aspect, a compound of the invention is provided as described above wherein $P^1$ and/or $P^2$ are independently selected from a peptide set out in any one of Tables 4 through 20. In one aspect, $P^1$ and/or $P^2$ have the same amino acid sequence.

In another aspect, a compound of the invention is provided as described above wherein $F^1$ is an Fc domain. In another aspect, a compound of the invention is provided wherein WSP is PEG. In yet another aspect, a compound as described above is provided wherein $F^1$ is an Fc domain and WSP is PEG.

In another embodiment, a substantially homogenous compound is provided comprising the structure:

```
                                                    (SEQ ID NO: 1)
WSP-Fc-GGGGG-IEGPTLRQWLAARA-GGGGGGGG-IEGPTLRQWLAARA
``` wherein WSP is a water soluble polymer, said compound having a property of binding to c-Mpl and stimulating platelet production, said compound having a property of improved bioefficacy in multidose administration. Multimers and dimers of a compound having this structure are also contemplated.

In another embodiment, a substantially homogenous compound is provided comprising the structure:

```
                                                    (SEQ ID NO: 2)
PEG-Fc-GGGGG-IEGPTLRQWLAARA-GGGGGGGG-IEGPTLRQWLAARA
``` said compound having a property of binding to c-Mpl and stimulating platelet production, said compound having a property of improved bioefficacy in multidose administration. Multimers and dimers of a compound having this structure are contemplated.

In one aspect, the PEG component of a compound of the invention has a molecular weight of between about 2 kDa and 100 kDa. In another aspect, the PEG component of a compound of the invention has a molecular weight of between about 6 kDa and 25 kDa.

The invention further provides a composition comprising a compound of the invention wherein the composition comprises at least 50% PEGylated compound. In another aspect, the composition of the invention comprises at least 75% PEGylated compound, at least 85% PEGylated compound, at least 90% PEGylated compound, at least 95% PEGylated compound, and at least 99% PEGylated compound.

In one embodiment, the invention also provides a substantially homogenous compound having the structure:

```
                                                    (SEQ ID NO: 2)
PEG-Fc-GGGGG-IEGPTLRQWLAARA-GGGGGGGG-IEGPTLRQWLAARA
``` wherein PEG has a molecule weight of about 20 kD, said compound of SEQ ID NO: 2 being a dimer and having a property of binding to c-Mpl and stimulating platelet production, and said compound having a property of improved bioefficacy in multidose administration.

The invention further provides a pharmaceutical composition comprising: (a) a substantially homogenous compound having the structure:

```
                                              (SEQ ID NO: 2)
PEG-Fc-GGGGG-IEGPTLRQWLAARA-GGGGGGGG-IEGPTLRQWLAARA
``` wherein PEG has a molecule weight of about 20 kD, (b) at least 95% diPEGylated compound; and (c) a pharmaceutically acceptable diluent, adjuvant or carrier, said composition having a property of improved bioefficacy in multidose administration.

In one embodiment, a pharmaceutical composition is provided comprising: (a) a substantially homogenous compound having the structure:

```
                                              (SEQ ID NO: 2)
PEG-Fc-GGGGG-IEGPTLRQWLAARA-GGGGGGGG-IEGPTLRQWLAARA
``` wherein PEG has a molecule weight of about 20 kD and the compound of SEQ ID NO: 2 is a dimer, (b) at least 95% diPEGylated compound; and (c) a pharmaceutically acceptable diluent, adjuvant or carrier, said composition having a property of improved bioefficacy in multidose administration.

The invention also provide a method of treating a hematopoietic disorder comprising administering a compound or composition of the invention in a regimen effective to treat said disorder.

BRIEF DESCRIPTION OF THE FIGURE

Numerous other aspects and advantages of the present invention will therefore be apparent upon consideration of the following detailed description thereof, reference being made to the drawing wherein:

FIG. 1 shows increase in platelet production in vivo in a multidose administration regimen with a PEG-Fc-TMP of the invention, wherein results using a PEG-Fc-TMP are shown with triangles (▲) and results using an Fc-TMP are shown with circles (●). Squares (■) represent a control.

DETAILED DESCRIPTION OF THE INVENTION

Definition of Terms

The term "comprising" means that a compound may include additional amino acids on either or both of the N- or C-termini of the given sequence. Of course, these additional amino acids should not significantly interfere with the activity of the compound.

"Substantially homogenous" as used herein with reference to a preparation of the invention means that the preparation includes a single species of a therapeutic compound detectable in the preparation of total therapeutic molecules in the preparation, unless otherwise stated at a specific percentage of total therapeutic molecules. In general, a substantially homogenous preparation is homogenous enough to display the advantages of a homogenous preparation, e.g., ease in clinical application in predictability of lot to lot pharmacokinetics.

"Bioefficacy" refers to the capacity to produce a desired biological effect. Bioefficacy of different compounds, or different dosages of the same compound, or different administrations of the same compound are generally normalized to the amount of compound(s) to permit appropriate comparison.

"Multidose administration" refers to a therapeutic or prophylactic treatment regimen which includes administration of more than one amount of a compound over a period of time.

The term "vehicle" refers to a molecule that prevents degradation and/or increases half-life, reduces toxicity, reduces immunogenicity, or increases biological activity of a therapeutic protein. Exemplary vehicles include an Fc domain as well as a linear polymer; a branched-chain polymer (see, for example, U.S. Pat. Nos. 4,289,872 to Denkenwalter et al., issued Sep. 15, 1981; 5,229,490 to Tam, issued Jul. 20, 1993; WO 93/21259 by Frechet et al., published 28 Oct. 1993); a lipid; a cholesterol group; a carbohydrate or oligosaccharide; or any natural or synthetic protein, polypeptide or peptide that binds to a salvage receptor. Vehicles are further described hereinafter.

The term "native Fc" refers to molecule or sequence comprising the sequence of a non-antigen-binding fragment resulting from digestion of whole antibody, whether in monomeric or multimeric form. The original immunoglobulin source of the native Fc is in one aspect of human origin and may be any of the immunoglobulins. A native Fc is a monomeric polypeptide that may be linked into dimeric or multimeric forms by covalent association (i.e., disulfide bonds), non-covalent association or a combination of both. The number of intermolecular disulfide bonds between monomeric subunits of native Fc molecules ranges from one to four depending on class (e.g., IgG, IgA, IgE) or subclass (e.g., IgG1, IgG2, IgG3, IgA1, IgA2). One example of a native Fc is a disulfide-bonded dimer resulting from papain digestion of an IgG. Ellison et al. (1982), Nucleic Acids Res. 10: 4071-9. The term "native Fc" as used herein is generic to the monomeric, dimeric, and multimeric forms.

The term "Fc variant" refers to a molecule or sequence that is modified from a native Fc, but still comprises a binding site for the salvage receptor, FcRn. International applications WO 97/34631 (published 25 Sep. 1997) and WO 96/32478 describe exemplary Fc variants, as well as interaction with the salvage receptor, and are hereby incorporated by reference. In one aspect, the term "Fc variant" comprises a molecule or sequence that is humanized from a non-human native Fc. In another aspect, a native Fc comprises sites that may be removed because they provide structural features or biological activity that are not required for the fusion molecules of the present invention. Thus, the term "Fc variant" comprises a molecule or sequence that lacks one or more native Fc sites or residues that affect or are involved in (1) disulfide bond formation, (2) incompatibility with a selected host cell (3) N-terminal heterogeneity upon expression in a selected host cell, (4) glycosylation, (5) interaction with complement, (6) binding to an Fc receptor other than a salvage receptor, or (7) antibody-dependent cellular cytotoxicity (ADCC). Fc variants are described in further detail hereinafter.

The term "Fc domain" encompasses native Fc and Fc variant molecules and sequences as defined above. As with Fc variants and native Fcs, the term "Fc domain" includes molecules in monomeric or multimeric form, whether digested from whole antibody or produced by other means. In one embodiment, for example, the Fc region can be:

```
                                              (SEQ ID NO: 1696)
DKTHTCPPCPAPELLGGPSVFLFPPKPKDTLMISRTPEVTCVVVDVSHED

PEVKFNWYVDGVEVHNAKTKPREEQYNSTYRVVSVLTVLHQDWLNGKEYK

CKVSNKALPAPIEKTISKAKGQPREPQVYTLPPSRDELTKNQVSLTCLVK

GFYPSDIAVEWESNGQPENNYKTTPPVLDSDGSFFLYSKLTVDKSRWQQG

NVFSCSVMHEALHNYTQKSLSLSPGK.
```

The term "multimer" as applied to Fc domains or molecules comprising Fc domains refers to molecules having two or more polypeptide chains associated covalently, noncovalently, or by both covalent and non-covalent interactions. IgG molecules typically form dimers; IgM, pentamers; IgD, dimers; and IgA, monomers, dimers, trimers, or tetramers. Multimers may be formed by exploiting the sequence and resulting activity of the native Ig source of the Fc or by derivatizing (as defined below) such a native Fc.

The terms "derivatizing," "derivative" or "derivatized" comprise processes and resulting compounds in which, for example and without limitation, (1) the compound has a cyclic portion; for example, cross-linking between cysteinyl residues within the compound; (2) the compound is cross-linked or has a cross-linking site; for example, the compound has a cysteinyl residue and thus forms cross-linked dimers in culture or in vivo; (3) one or more peptidyl linkage is replaced by a non-peptidyl linkage; (4) the N-terminus is replaced by $—NRR_1$, $NRC(O)R_1$, $—NRC(O)OR_1$, $—NRS(O)_2R_1$, $—NHC(O)NHR$, a succinimide group, or substituted or unsubstituted benzyloxycarbonyl-NH—, wherein R and $R_1$ and the ring substituents are as defined hereinafter; (5) the C-terminus is replaced by $—C(O)R_2$ or $—NR_3R_4$ wherein $R_2$, $R_3$ and $R_4$ are as defined hereinafter; and (6) compounds in which individual amino acid moieties are modified through treatment with agents capable of reacting with selected side chains or terminal residues. Derivatives are further described hereinafter.

The term "peptide" refers to molecules of 2 to 40 amino acids, molecules of 3 to 20 amino acids, and those of 6 to 15 amino acids. For example, peptides having a size selected from no greater than 35, no greater than 30, no greater than 25, no greater than 20 amino acids and/or no greater than 15 amino acids, are contemplated herein. Exemplary peptides may be randomly generated by any of the methods cited described herein, carried in a peptide library (e.g., a phage display library), derived by digestion of proteins, or chemically synthesized. Peptides include D and L form, either purified or in a mixture of the two forms.

The term "randomized" as used to refer to peptide sequences refers to fully random sequences (e.g., selected by phage display methods) and sequences in which one or more residues of a naturally occurring molecule is replaced by an amino acid residue not appearing in that position in the naturally occurring molecule. Exemplary methods for identifying peptide sequences include phage display, *E. coli* display, ribosome display, yeast-based screening, RNA-peptide screening, chemical screening, rational design, protein structural analysis, and the like.

The term "pharmacologically active" means that a substance so described is determined to have activity that affects a medical parameter (e.g., blood pressure, blood cell count, cholesterol level) or disease state (e.g., cancer, autoimmune disorders). Thus, pharmacologically active peptides comprise agonistic or mimetic and antagonistic peptides as defined below.

The terms "-mimetic peptide" and "-agonist peptide" refer to a peptide having biological activity comparable to a protein (e.g., EPO, TPO, G-CSF) that interacts with a protein of interest. These terms further include peptides that indirectly mimic the activity of a protein of interest, such as by potentiating the effects of the natural ligand of the protein of interest; see, for example, the G-CSF-mimetic peptides listed in Tables 2 and 7. As an example, the term "EPO-mimetic peptide" comprises any peptides that can be identified or derived as described in Wrighton et al. (1996), Science 273: 458-63, Naranda et al. (1999), Proc. Natl. Acad. Sci. USA 96: 7569-74, or any other reference in Table 2 identified as having EPO-mimetic subject matter. Those of ordinary skill in the art appreciate that each of these references enables one to select different peptides than actually disclosed therein by following the disclosed procedures with different peptide libraries.

As another example, the term "TPO-mimetic peptide" or "TMP" comprises peptides that can be identified or derived as described in Cwirla et al. (1997), Science 276: 1696-9, U.S. Pat. Nos. 5,869,451 and 5,932,946 and any other reference in Table 2 identified as having TPO-mimetic subject matter, as well as International application WO 00/24770 published May 4, 2000, hereby incorporated by reference. Those of ordinary skill in the art appreciate that each of these references enables one to select different peptides than actually disclosed therein by following the disclosed procedures with different peptide libraries.

As another example, the term "G-CSF-mimetic peptide" comprises any peptides that can be identified or described in Paukovits et al. (1984), Hoppe-Seylers Z. Physiol. Chem. 365: 303-11 or any of the references in Table 2 identified as having G-CSF-mimetic subject matter. Those of ordinary skill in the art appreciate that each of these references enables one to select different peptides than actually disclosed therein by following the disclosed procedures with different peptide libraries.

The term "CTLA4-mimetic peptide" comprises any peptides that can be identified or derived as described in Fukumoto et al. (1998), Nature Biotech. 16: 267-70. Those of ordinary skill in the art appreciate that each of these references enables one to select different peptides than actually disclosed therein by following the disclosed procedures with different peptide libraries.

The term "-antagonist peptide" or "inhibitor peptide" refers to a peptide that blocks or in some way interferes with the biological activity of the associated protein of interest, or has biological activity comparable to a known antagonist or inhibitor of the associated protein of interest. Thus, the term "TNF-antagonist peptide" comprises peptides that can be identified or derived as described in Takasaki et al. (1997), Nature Biotech. 15: 1266-70 or any of the references in Table 2 identified as having TNF-antagonistic subject matter. Those of ordinary skill in the art appreciate that each of these references enables one to select different peptides than actually disclosed therein by following the disclosed procedures with different peptide libraries.

The terms "IL-1 antagonist" and "IL-1ra-mimetic peptide" comprises peptides that inhibit or down-regulate activation of the IL-1 receptor by IL-1. IL-1 receptor activation results from formation of a complex among IL-1, IL-1 receptor, and IL-1 receptor accessory protein. IL-1 antagonist or IL-1ra-mimetic peptides bind to IL-1, IL-1 receptor, or IL-1 receptor accessory protein and obstruct complex formation among any two or three components of the complex. Exemplary IL-1 antagonist or IL-1ra-mimetic peptides can be identified or derived as described in U.S. Pat. Nos. 5,608,035, 5,786,331, 5,880,096, or any of the references in Table 2 identified as having IL-1ra-mimetic or IL-1 antagonistic subject matter. Those of ordinary skill in the art appreciate that each of these references enables one to select different peptides than actually disclosed therein by following the disclosed procedures with different peptide libraries.

The term "VEGF-antagonist peptide" comprises peptides that can be identified or derived as described in Fairbrother (1998), Biochem. 37: 17754-64, and in any of the references in Table 2 identified as having VEGF-antagonistic subject matter. Those of ordinary skill in the art appreciate that each of these references enables one to select different peptides than actually disclosed therein by following the disclosed procedures with different peptide libraries.

The term "MMP inhibitor peptide" comprises peptides that can be identified or derived as described in Koivunen (1999), Nature Biotech. 17: 768-74 and in any of the references in Table 2 identified as having MMP inhibitory subject matter. Those of ordinary skill in the art appreciate that each of these references enables one to select different peptides than actually disclosed therein by following the disclosed procedures with different peptide libraries.

The term "myostatin inhibitor peptide" comprises peptides that can be identified by their ability to reduce or block myostatin activity or signaling as demonstrated in in vitro assays such as, for example the pMARE C2C12 cell-based myostatin activity assay or by in vivo animal testing as described in U.S. patent application Publication No US20040181033A1 and PCT application publication No. WO2004/058988. Exemplary myostatin inhibitor pepetides are set out in Tables 21-24.

The term "integrin/adhesion antagonist" comprises peptides that inhibit or down-regulate the activity of integrins, selectins, cell adhesion molecules, integrin receptors, selectin receptors, or cell adhesion molecule receptors. Exemplary integrin/adhesion antagonists comprise laminin, echistatin, the peptides described in Tables 25-28.

The term "bone resorption inhibitor" refers to such molecules as determined by the assays of Examples 4 and 11 of WO 97/23614, which is hereby incorporated by reference in its entirety. Exemplary bone resorption inhibitors include OPG and OPG-L antibody, which are described in WO 97/23614 and WO98/46751, respectively, which are hereby incorporated by reference in their entirety.

The term "nerve growth factor inhibitor" or "nerve growth factor agonist" comprises a peptide that binds to and inhibits nerve growth factor (NGF) activity or signaling. Exemplary peptides of this type are set out in Table 29.

The term "TALL-1 modulating domain" refers to any amino acid sequence that binds to the TALL-1 and comprises naturally occurring sequences or randomized sequences. Exemplary TALL-1 modulating domains can be identified or derived by phage display or other methods mentioned herein. Exemplary peptides of this type are set out in Tables 30 and 31.

The term "TALL-1 antagonist" refers to a molecule that binds to the TALL-1 and increases or decreases one or more assay parameters opposite from the effect on those parameters by full length native TALL-1. Such activity can be determined, for example, by such assays as described in the subsection entitled "Biological activity of AGP-3" in the Materials & Methods section of the patent application entitled, "TNF-RELATED PROTEINS", WO 00/47740, published Aug. 17, 2000.

The term "Ang 2-antagonist peptide" comprises peptides that can be identified or derived as having Ang-2-antagonistic characteristics. Exemplary peptides of this type are set out in Tables 32-38.

Additionally, physiologically acceptable salts of the compounds of this invention are also contemplated. By "physiologically acceptable salts" is meant any salts that are known or later discovered to be pharmaceutically acceptable. Some specific examples are: acetate; trifluoroacetate; hydrohalides, such as hydrochloride and hydrobromide; sulfate; citrate; tartrate; glycolate; and oxalate.

The term "WSP" refers to a water soluble polymer which prevents a peptide, protein or other compound to which it is attached from precipitating in an aqueous environment, such as, by way of example, a physiological environment. A more detailed description of various WSP embodiments contemplated by the invention follows.

Structure of Compounds

In General. In preparations in accordance with the invention, a peptide is attached to a vehicle through the N-terminus or C-terminus of the peptide, and the resulting structure further modified with a covalently attached WSP which is attached to the vehicle moiety in the vehicle-peptide product. Thus, the WSP-vehicle-peptide molecules of this invention may be described by the following formula I:

$$[(X^1)_a-F^1-(X^2)_b]-(L^1)_c-WSP_d \qquad \text{I}$$

wherein:
$F^1$ is a vehicle;
$X^1$ is selected from
$P^1-(L^2)_e-$
$P^2-(L^3)_f-P^1-(L^2)_e-$
$P^3-(L^4)-P^2-(L^3)_f-P^1-(L^2)_e-$ and
$P^4-(L^5)_h-P^3-(L^4)_g-P^2-(L^3)_f-P^1-(L^2)_e-$
$X^2$ is selected from:
$-(L^2)_e-P^1,$
$-(L^2)_e-P^1-(L^3)_f-P^2,$
$-(L^2)_e-P^1-(L^3)_f-P^2-(L^4)_g-P^3,$ and
$-(L^2)_e-P^1-(L^3)_f-P^2-(L^4)_g-P^3-(L^5)_h-P^4$
wherein $P^1$, $P^2$, $P^3$, and $P^4$ are each independently sequences of pharmacologically active peptides;
$L^1$, $L^2$, $L^3$, $L^4$, and $L^5$ are each independently linkers;
a, b, c, e, f, g, and h are each independently 0 or 1,
provided that at least one of a and b is 1;
d is at least 1; and
WSP is a water soluble polymer, the attachment of which is effected at any reactive moiety in $F^1$.

Thus, compound I comprises compounds of the formulae $$[X^1-F^1]-(L^1)_c-WSP_d \qquad \text{II}$$

including multimers thereof, wherein $F^1$ is an Fc domain and is attached at the C-terminus of $X^1$, and one or more WSP is attached to the Fc domain, optionally through linker $L^1$;

$$[F^1-X^2]-(L^1)_c-WSP_d \qquad \text{III}$$

including multimers thereof, wherein $F^1$ is an Fc domain and is attached at the N-terminus of $X^2$, and one or more WSP is attached to the Fc domain, optionally through linker $L^1$;

$$[F^1-(L^2)_e-P^1]-(L^1)_c-WSP_d \qquad \text{IV}$$

including multimers thereof, wherein $F^1$ is an Fc domain and is attached at the N-terminus of $-(L^1)_c-P^1$ and one or more WSP is attached to the Fc domain, optionally through linker $L^1$; and $$[F^1-(L^2)_e-P^1-(L^3)_f-P^2]-(L^1)_c-WSP_d \qquad \text{V}$$

including multimers thereof, wherein $F^1$ is an Fc domain and is attached at the N-terminus of $-L^2-P^1-L^3-P^2$ and one or more WSP is attached to the Fc domain, optionally through linker $L^1$.

Peptides. Any number of peptides may be used in conjunction with the present invention. Of particular interest are peptides that mimic the activity of EPO, TPO, growth hormone, G-CSF, GM-CSF, IL-1ra, leptin, CTLA4, TRAIL, TGF-α, and TGF-β. Peptide antagonists are also of interest, particularly those antagonistic to the activity of TNF, leptin, any of the interleukins (IL-1, 2, 3, . . . ), and proteins involved in complement activation (e.g., C3b). Targeting peptides are also of interest, including tumor-homing peptides, membrane-transporting peptides, and the like. All of these classes of peptides may be discovered by methods described in the references cited in this specification and other references.

Phage display, in particular, is useful in generating peptides for use in the present invention. It has been stated that affinity selection from libraries of random peptides can be used to identify peptide ligands for any site of any gene product. Dedman et al. (1993), J. Biol. Chem. 268: 23025-30. Phage display is particularly well suited for identifying peptides that bind to such proteins of interest as cell surface receptors or any proteins having linear epitopes. Wilson et al. (1998), Can. J. Microbiol. 44: 313-29; Kay et al. (1998), Drug Disc. Today 3: 370-8. Such proteins are extensively reviewed in Herz et al. (1997), J. Receptor & Signal Transduction Res. 17(5): 671-776, which is hereby incorporated by reference. Such proteins of interest are preferred for use in this invention.

By way of example and without limitation, a group of peptides that bind to cytokine receptors are provided. Cytokines have recently been classified according to their receptor code. See Inglot (1997), Archivum Immunologiae et Therapiae Experimentalis 45: 353-7, which is hereby incorporated by reference. Among these receptors are the CKRs (family I in Table 3). The receptor classification appears in Table 3.

TABLE 3

Cytokine Receptors Classified by Receptor Code

| Cytokines (ligands) | | | Receptor Type | | |
|---|---|---|---|---|---|
| family | | subfamily | family | | subfamily |
| I. Hematopoietic cytokines | 1. | IL-2, IL-4, IL-7, IL-9, IL-13, IL-15 | I. Cytokine R (CKR) | 1. | shared γCr, IL-9R, IL-4R |
| | 2. | IL-3, IL-5, GM-CSF | | 2. | shared GP 140 βR |
| | 3. | IL-6, IL-11, IL-12, LIF, OSM, CNTF, Leptin (OB) | | 3. | 3.shared RP 130, IL-6 R, Leptin R |
| | 4. | G-CSF, EPO, TPO, PRL, GH | | 4. | "single chain" R, GCSF-R, TPO-R, GH-R |
| | 5. | IL-17, HVS-IL-17[1] | | 5. | other R[2] |
| II. IL-10 ligands | | IL-10, BCRF-1, HSV-IL-10 | II. IL-10 R | | |
| III. Interferons | 1. | IFN-α1, α2, α4, m, t, IFN-β[3] | III. Interferon R | 1. | IFNAR |
| | 2. | IFN-γ | | 2. | IFNGR |
| IV. IL-1 and IL-1 like ligands | 1. | IL-1α, IL-1β, IL-1Ra | IV. IL-1R | 1. | IL-1R, IL-1RAcP |
| | 2. | IL-18, IL-18BP | | 2. | IL-18R, IL-18RAcP |
| V. TNF family | 1. | TNF-α, TNF-β (LT), FASL,CD40 L, CD30L, CD27 L, OX40L, OPGL, TRAIL, APRIL, AGP-3, BLys, TL5, Ntn-2, KAY, Neutrokine-α | 3. NGF/TNF R[4] | | TNF-RI, AGP-3R, DR4, DR5, OX40, OPG, TACI, CD40, FAS, ODR |
| VI. Chemokines | 1. | α chemokines: IL-8, GRO α, β, γ, IF-10, PF-4, SDF-1 | 4. Chemokine R | 1. | CXCR |
| | 2. | β chemokines: MIP1α, MIP1β, MCP-1, 2, 3, 4, RANTES, eotaxin | | 2. | CCR |
| | 3. | γ chemokines: lymphotactin | | 3. | CR |
| | | | | 4. | DARC[5] |
| VII. Growth factors | 1.1 | SCF, M-CSF, PDGF-AA, AB, BB, KDR, FLT-1, FLT-3L, VEGF, SSV-PDGF, HGF, SF | VII. RKF | 1. | TK sub-family |
| | | | | 1.1 | IgTK III R,VEGF-RI, VEGF-RII |
| | 1.2 | FGFα, FGFβ | | 1.2 | IgTK IV R |
| | 1.3 | EGF, TGF-α, VV-F19 (EGF-like) | | 1.3 | Cysteine-rich TK-I |
| | 1.4 | IGF-I, IGF-II, Insulin | | 1.4 | Cysteine rich TK-II, IGF-RI |
| | 1.5 | NGF, BDNF, NT-3, NT-4[6] | | 1.5 | Cysteine knot TK V |
| | 2. | TGF-β1, β2, β3 | | 2. | Serine-threonine kinase subfamily (STKS)[7] |

[1] IL-17R - belongs to CKR family but is unassigned to 4 indicated subjamilies.
[2] Other IFN type I subtypes remain unassigned. Hematopoietic cytokines, IL-10 ligands and interferons do not possess functional intrinsic protein kinases. The signaling molecules for the cytokines are JAK's, STATs and related non-receptor molecules. IL-14. IL-16 and IL-18 have been cloned but according to the receptor code they remain unassigned.
[3] TNF receptors use multiple, distinct intracellular molecules for signal transduction including "death domain" of FAS R and 55 kDa TNF-□R that participates in their cytotoxic effects. NGF/TNF R can bind both NGF and related factors as well as TNF ligands. Chemokine receptors are seven transmembrane (7 TM, serpentine) domain receptors. They are G protein-coupled.
[4] The Duffy blood group antigen (DARC) is an erythrocyte receptor that can bind several different chemokines. IL-1R belongs to the immunoglobulin superfamily but their signal transduction events characteristics remain unclear.
[5] The neurotrophic cytokines can associate with NGF/TNF receptors also.
[6] STKS may encompass many other TGF-β-related factors that remain unassigned. The protein kinases are intrinsic part of the intracellular domain of receptor kinase family (RKF). The enzymes participate in the signals transmission via the receptors.

Other proteins of interest as targets for peptide generation in the present invention include the following:

(αvβ3
αVβ1
Ang-2
B7
B7RP1
CRP1
Calcitonin
CD28
CETP
cMet
Complement factor B
C4b
CTLA4
Glucagon
Glucagon Receptor
LIPG
MPL
splice variants of molecules preferentially expressed on tumor cells; e.g., CD44, CD30
unglycosylated variants of mucin and Lewis Y surface glycoproteins CD19, CD20, CD33, CD45
prostate specific membrane antigen and prostate specific cell antigen matrix metalloproteinases (MMPs), both secreted and membrane-bound (e.g., MMP-9)
Cathepsins
TIE-2 receptor
heparanase
urokinase plasminogen activator (UPA), UPA receptor
parathyroid hormone (PTH), parathyroid hormone-related protein (PTHrP),
PTH-RI, PTH-RII
Her2
Her3
Insulin
Myostatin
TALL-1
Nerve growth factor
Integrins and receptors
Selectins and receptors thereof.
Cell adhesion molecules and receptors thereof.

Exemplary peptides appear in Tables 4 through 38 below. These peptides may be prepared by any methods disclosed in the art, many of which are discussed herein. In most tables that follow, single letter amino acid abbreviations are used. The X in these sequences (and throughout this specification, unless specified otherwise in a particular instance) means that any of the 20 naturally occurring amino acid residues may be present. Any of these peptides may be linked in tandem (i.e., sequentially), with or without linkers, and a few tandem-linked examples are provided in the table. Linkers are listed as "Λ" and may be any of the linkers described herein. Tandem repeats and linkers are shown separated by dashes for clarity. Any peptide containing a cysteinyl residue may be cross-linked with another Cys-containing peptide, either or both of which may be linked to a vehicle. A few cross-linked examples are provided in the table. Any peptide having more than one Cys residue may form an intrapeptide disulfide bond, as well; see, for example, EPO-mimetic peptides in Table 5. A few examples of intrapeptide disulfide-bonded peptides are specified in the table. Any of these peptides may be derivatized as described herein, and a few derivatized examples are provided in the table. Derivatized peptides in the tables are exemplary rather than limiting, as the associated underivatized peptides may be employed in this invention, as well. For derivatives in which the carboxyl terminus may be capped with an amino group, the capping amino group is shown as —NH$_2$. For derivatives in which amino acid residues are substituted by moieties other than amino acid residues, the substitutions are denoted by σ, which signifies any of the moieties described in Bhatnagar et al. (1996), J. Med. Chem. 39: 3814-9 and Cuthbertson et al. (1997), J. Med. Chem. 40: 2876-82, which are incorporated by reference. The J substituent and the Z substituents ($Z_5$, $Z_6$, . . . $Z_{40}$) are as defined in U.S. Pat. Nos. 5,608,035, 5,786,331, and 5,880,096, which are incorporated by reference. For the EPO-mimetic sequences (Table 5), the substituents $X_2$ through $X_{11}$ and the integer "n" are as defined in WO 96/40772, which is incorporated by reference. Also for the EPO-mimetic sequences, the substituents $X_{na}$, $X_{1a}$, $X_{2a}$, $X_{3a}$, $X_{4a}$, $X_{5a}$ and $X_{ca}$ follow the definitions of $X_n$, $X_1$, $X_2$, $X_3$, $X_4$, $X_5$, and $X_c$, respectively, of WO 99/47151, which is also incorporated by reference. The substituents "Ψ," "Θ," and "+" are as defined in Sparks et al. (1996), Proc. Natl. Acad. Sci. 93: 1540-4, which is hereby incorporated by reference. $X_4$, $X_5$, $X_6$, and $X_7$ are as defined in U.S. Pat. No. 5,773,569, which is hereby incorporated by reference, except that: for integrin-binding peptides, $X_1$, $X_2$, $X_3$, $X_4$, $X_5$, $X_6$, $X_7$, and $X_8$ are as defined in International applications WO 95/14714, published Jun. 1, 1995 and WO 97/08203, published Mar. 6, 1997, which are also incorporated by reference; and for VIP-mimetic peptides, $X_1$, $X_1'$, $X_1''$, $X_2$, $X_3$, $X_4$, $X_5$, $X_6$ and Z and the integers m and n are as defined in WO 97/40070, published Oct. 30, 1997, which is also incorporated by reference. Xaa and Yaa below are as defined in WO 98/09985, published Mar. 12, 1998, which is incorporated by reference. $AA_1$, $AA_2$, $AB_1$, $AB_2$, and AC are as defined in International application WO 98/53842, published Dec. 3, 1998, which is incorporated by reference. $X^1$, $X^2$, $X^3$, and $X^4$ in Table 17 only are as defined in European application EP 0 911 393, published Apr. 28, 1999. Residues appearing in boldface are D-amino acids. All peptides are linked through peptide bonds unless otherwise noted. Abbreviations are listed at the end of this specification. In the "SEQ ID NO." column, "NR" means that no sequence listing is required for the given sequence.

TABLE 4

| IL-1 antagonist peptide sequences | |
|---|---|
| Sequence/structure | SEQ ID NO: |
| $Z_{11}Z_7Z_8QZ_5YZ_6Z_9Z_{10}$ | 3 |
| XXQZ$_5$YZ$_6$XX | 4 |
| Z$_7$XQZ$_5$YZ$_6$XX | 5 |
| Z$_7$Z$_8$QZ$_5$YZ$_6$Z$_9$Z$_{10}$ | 6 |
| Z$_{11}$Z$_7$Z$_8$QZ$_5$YZ$_6$Z$_9$Z$_{10}$ | 7 |
| $Z_{12}Z_{13}Z_{14}Z_{15}Z_{16}Z_{17}Z_{18}Z_{19}Z_{20}Z_{21}Z_{22}Z_{11}Z_7Z_8QZ_5YZ_6Z_9Z_{10}L$ | 8 |
| Z$_{23}$NZ$_{24}$Z$_{39}$Z$_{25}$Z$_{26}$Z$_{27}$Z$_{28}$Z$_{29}$Z$_{30}$Z$_{40}$ | 9 |
| TANVSSFEWTPYYWQPYALPL | 10 |
| SWTDYGYWQPYALPISGL | 11 |
| ETPFTWEESNAYYWQPYALPL | 12 |
| ENTYSPNWADSMYWQPYALPL | 13 |
| SVGEDHNFWTSEYWQPYALPL | 14 |

TABLE 4-continued

IL-1 antagonist peptide sequences

| Sequence/structure | SEQ ID NO: |
|---|---|
| DGYDRWRQSGERYWQPYALPL | 15 |
| FEWTPGYWQPY | 16 |
| FEWTPGYWQHY | 17 |
| FEWTPGWYQJY | 18 |
| AcFEWTPGWYQJY | 19 |
| FEWTPGWpYQJY | 20 |
| FAWTPGYWQJY | 21 |
| FEWAPGYWQJY | 22 |
| FEWVPGYWQJY | 23 |
| FEWTPGYWQJY | 24 |
| AcFEWTPGYWQJY | 25 |
| FEWTPaWYQJY | 26 |
| FEWTPSarWYQJY | 27 |
| FEWTPGYYQPY | 28 |
| FEWTPGWWQPY | 29 |
| FEWTPNYWQPY | 30 |
| FEWTPvYWQJY | 31 |
| FEWTPecGYWQJY | 32 |
| FEWTPAibYWQJY | 33 |
| FEWTSarGYWQJY | 34 |
| FEWTPGYWQPY | 35 |
| FEWTPGYWQHY | 36 |
| FEWTPGWYQJY | 37 |
| AcFEWTPGWYQJY | 38 |
| FEWTPGW-pY-QJY | 39 |
| FAWTPGYWQJY | 40 |
| FEWAPGYWQJY | 41 |
| FEWVPGYWQJY | 42 |
| FEWTPGYWQJY | 43 |
| AcFEWTPGYWQJY | 44 |
| FEWTPAWYQJY | 45 |
| FEWTPSarWYQJY | 46 |
| FEWTPGYYQPY | 47 |
| FEWTPGWWQPY | 48 |
| FEWTPNYWQPY | 49 |
| FEWTPVYWQJY | 50 |
| FEWTPecGYWQJY | 51 |
| FEWTPAibYWQJY | 52 |
| FEWTSarGYWQJY | 53 |
| FEWTPGYWQPYALPL | 54 |
| 1NapEWTPGYYQJY | 55 |
| YEWTPGYYQJY | 56 |
| FEWVPGYYQJY | 57 |
| FEWTPSYYQJY | 58 |
| FEWTPNYYQJY | 59 |
| TKPR | 60 |
| RKSSK | 61 |
| RKQDK | 62 |
| NRKQDK | 63 |
| RKQDKR | 64 |
| ENRKQDKRF | 65 |
| VTKFYF | 66 |
| VTKFY | 67 |
| VTDFY | 68 |
| SHLYWQPYSVQ | 69 |
| TLVYWQPYSLQT | 70 |
| RGDYWQPYSVQS | 71 |
| VHVYWQPYSVQT | 72 |
| RLVYWQPYSVQT | 73 |
| SRVWFQPYSLQS | 74 |
| NMVYWQPYSIQT | 75 |
| SVVFWQPYSVQT | 76 |
| TFVYWQPYALPL | 77 |
| TLVYWQPYSIQR | 78 |
| RLVYWQPYSVQR | 79 |
| SPVFWQPYSIQI | 80 |
| WIEWWQPYSVQS | 81 |
| SLIYWQPYSLQM | 82 |
| TRLYWQPYSVQR | 83 |
| RCDYWQPYSVQT | 84 |
| MRVFWQPYSVQN | 85 |
| KIVYWQPYSVQT | 86 |
| RHLYWQPYSVQR | 87 |
| ALVWWQPYSEQI | 88 |

TABLE 4-continued

IL-1 antagonist peptide sequences

| Sequence/structure | SEQ ID NO: |
|---|---|
| SRVWFQPYSLQS | 89 |
| WEQPYALPLE | 90 |
| QLVWWQPYSVQR | 91 |
| DLRYWQPYSVQV | 92 |
| ELVWWQPYSLQL | 93 |
| DLVWWQPYSVQW | 94 |
| NGNYWQPYSFQV | 95 |
| ELVYWQPYSIQR | 96 |
| ELMYWQPYSVQE | 97 |
| NLLYWQPYSMQD | 98 |
| GYEWYQPYSVQR | 99 |
| SRVWYQPYSVQR | 100 |
| LSEQYQPYSVQR | 101 |
| GGGWWQPYSVQR | 102 |
| VGRWYQPYSVQR | 103 |
| VHVYWQPYSVQR | 104 |
| QARWYQPYSVQR | 105 |
| VHVYWQPYSVQT | 106 |
| RSVYWQPYSVQR | 107 |
| TRVWFQPYSVQR | 108 |
| GRIWFQPYSVQR | 109 |
| GRVWFQPYSVQR | 110 |
| ARTWYQPYSVQR | 111 |
| ARVWWQPYSVQM | 112 |
| RLMFYQPYSVQR | 113 |
| ESMWYQPYSVQR | 114 |
| HFGWWQPYSVHM | 115 |
| ARFWWQPYSVQR | 116 |
| RLVYWQ PYAPIY | 117 |
| RLVYWQ PYSYQT | 118 |
| RLVYWQ PYSLPI | 119 |
| RLVYWQ PYSVQA | 120 |
| SRVWYQ PYAKGL | 121 |
| SRVWYQ PYAQGL | 122 |
| SRVWYQ PYAMPL | 123 |
| SRVWYQ PYSVQA | 124 |
| SRVWYQ PYSLGL | 125 |

TABLE 4-continued

IL-1 antagonist peptide sequences

| Sequence/structure | SEQ ID NO: |
|---|---|
| SRVWYQ PYAREL | 126 |
| SRVWYQ PYSRQP | 127 |
| SRVWYQ PYFVQP | 128 |
| EYEWYQ PYALPL | 129 |
| IPEYWQ PYALPL | 130 |
| SRIWWQ PYALPL | 131 |
| DPLFWQ PYALPL | 132 |
| SRQWVQ PYALPL | 133 |
| IRSWWQ PYALPL | 134 |
| RGYWQ PYALPL | 135 |
| RLLWVQ PYALPL | 136 |
| EYRWFQ PYALPL | 137 |
| DAYWVQ PYALPL | 138 |
| WSGYFQ PYALPL | 139 |
| NIEFWQ PYALPL | 140 |
| TRDWVQ PYALPL | 141 |
| DSSWYQ PYALPL | 142 |
| IGNWYQ PYALPL | 143 |
| NLRWDQ PYALPL | 144 |
| LPEFWQ PYALPL | 145 |
| DSYWWQ PYALPL | 146 |
| RSQYYQ PYALPL | 147 |
| ARFWLQ PYALPL | 148 |
| NSYFWQ PYALPL | 149 |
| RFMYWQPYSVQR | 150 |
| AHLFWQPYSVQR | 151 |
| WWQPYALPL | 152 |
| YYQPYALPL | 153 |
| YFQPYALGL | 154 |
| YWYQPYALPL | 155 |
| RWWQPYATPL | 156 |
| GWYQPYALGF | 157 |
| YWYQPYALGL | 158 |
| IWYQPYAMPL | 159 |
| SNMQPYQRLS | 160 |
| TFVYWQPY AVGLPAAETACN | 161 |
| TFVYWQPY SVQMTITGKVTM | 162 |

TABLE 4-continued

IL-1 antagonist peptide sequences

| Sequence/structure | SEQ ID NO: |
|---|---|
| TFVYWQPY SSHXXVPXGFPL | 163 |
| TFVYWQPY YGNPQWAIHVRH | 164 |
| TFVYWQPY VLLELPEGAVRA | 165 |
| TFVYWQPY VDYVWPIPIAQV | 166 |
| GWYQPYVDGWR | 167 |
| RWEQPYVKDGWS | 168 |
| EWYQPYALGWAR | 169 |
| GWWQPYARGL | 170 |
| LFEQPYAKALGL | 171 |
| GWEQPYARGLAG | 172 |
| AWVQPYATPLDE | 173 |
| MWYQPYSSQPAE | 174 |
| GWTQPYSQQGEV | 175 |
| DWFQPYSIQSDE | 176 |
| PWIQPYARGFG | 177 |
| RPLYWQPYSVQV | 178 |
| TLIYWQPYSVQI | 179 |
| RFDYWQPYSDQT | 180 |
| WHQFVQPYALPL | 181 |
| EWDS VYWQPYSVQ TLLR | 182 |
| WEQN VYWQPYSVQ SFAD | 183 |
| SDV VYWQPYSVQ SLEM | 184 |
| YYDG VYWQPYSVQ VMPA | 185 |
| SDIWYQ PYALPL | 186 |
| QRIWWQ PYALPL | 187 |
| SRIWWQ PYALPL | 188 |
| RSLYWQ PYALPL | 189 |
| TIIWEQ PYALPL | 190 |
| WETWYQ PYALPL | 191 |
| SYDWEQ PYALPL | 192 |
| SRIWCQ PYALPL | 193 |
| EIMFWQ PYALPL | 194 |
| DYVWQQ PYALPL | 195 |
| MDLLVQ WYQPYALPL | 196 |
| GSKVIL WYQPYALPL | 197 |
| RQGANI WYQPYALPL | 198 |
| GGGDEP WYQPYALPL | 199 |
| SQLERT WYQPYALPL | 200 |
| ETWVRE WYQPYALPL | 201 |
| KKGSTQ WYQPYALPL | 202 |
| LQARMN WYQPYALPL | 203 |
| EPRSQK WYQPYALPL | 204 |
| VKQKWR WYQPYALPL | 205 |
| LRRHDV WYQPYALPL | 206 |
| RSTASI WYQPYALPL | 207 |
| ESKEDQ WYQPYALPL | 208 |
| EGLTMK WYQPYALPL | 209 |
| EGSREG WYQPYALPL | 210 |
| VIEWWQ PYALPL | 211 |
| VWYWEQ PYALPL | 212 |
| ASEWWQ PYALPL | 213 |
| FYEWWQ PYALPL | 214 |
| EGWWVQ PYALPL | 215 |
| WGEWLQ PYALPL | 216 |
| DYYWEQ PYALPL | 217 |
| AHTWWQ PYALPL | 218 |
| FIEWFQ PYALPL | 219 |
| WLAWEQ PYALPL | 220 |
| VMEWWQ PYALPL | 221 |
| ERMWQ PYALPL | 222 |
| NXXWXX PYALPL | 223 |
| WGNWYQ PYALPL | 224 |
| TLYWEQ PYALPL | 225 |
| VWRWEQ PYALPL | 226 |
| LLWTQ PYALPL | 227 |
| SRIWXX PYALPL | 228 |
| SDIWYQ PYALPL | 229 |
| WGYYXX PYALPL | 230 |
| TSGWYQ PYALPL | 231 |
| VHPYXX PYALPL | 232 |
| EHSYFQ PYALPL | 233 |
| XXIWYQ PYALPL | 234 |
| AQLHSQ PYALPL | 235 |
| WANWFQ PYALPL | 236 |

TABLE 4-continued

IL-1 antagonist peptide sequences

| Sequence/structure | SEQ ID NO: |
|---|---|
| SRLYSQ PYALPL | 237 |
| GVTFSQ PYALPL | 238 |
| SIVWSQ PYALPL | 239 |
| SRDLVQ PYALPL | 240 |
| HWGH VYWQPYSVQ DDLG | 241 |
| SWHS VYWQPYSVQ SYPE | 242 |
| WRDS VYWQPYSVQ PESA | 243 |
| TWDA VYWQPYSVQ KWLD | 244 |
| TPPW VYWQPYSVQ SLDP | 245 |
| YWSS VYWQPYSVQ SVHS | 246 |
| YWY QPY ALGL | 247 |
| YWY QPY ALPL | 248 |
| EWI QPY ATGL | 249 |
| NWE QPY AKPL | 250 |
| AFY QPY ALPL | 251 |
| FLY QPY ALPL | 252 |
| VCK QPY LEWC | 253 |
| ETPFTWEESNAYYWQPYALPL | 254 |
| QGWLTWQDSVDMYWQPYALPL | 255 |
| FSEAGYTWPENTYWQPYALPL | 256 |
| TESPGGLDWAKIYWQPYALPL | 257 |
| DGYDRWRQSGERYWQPYALPL | 258 |
| TANVSSFEWTPGYWQPYALPL | 259 |
| SVGEDHNFWTSE YWQPYALPL | 260 |
| MNDQTSEVSTFP YWQPYALPL | 261 |
| SWSEAFEQPRNL YWQPYALPL | 262 |
| QYAEPSALNDWG YWQPYALPL | 263 |
| NGDWATADWSNY YWQPYALPL | 264 |
| THDEHI YWQPYALPL | 265 |
| MLEKTYTTWTPG YWQPYALPL | 266 |
| WSDPLTRDADL YWQPYALPL | 267 |
| SDAFTTQDSQAM YWQPYALPL | 268 |
| GDDAAWRTDSLT YWQPYALPL | 269 |
| AIIRQLYRWSEM YWQPYALPL | 270 |
| ENTYSPNWADSM YWQPYALPL | 271 |
| MNDQTSEVSTFP YWQPYALPL | 272 |
| SVGEDHNFWTSE YWQPYALPL | 273 |
| QTPFTWEESNAY YWQPYALPL | 274 |
| ENPFTWQESNAY YWQPYALPL | 275 |
| VTPFTWEDSNVF YWQPYALPL | 276 |
| QIPFTWEQSNAY YWQPYALPL | 277 |
| QAPLTWQESAAY YWQPYALPL | 278 |
| EPTFTWEESKAT YWQPYALPL | 279 |
| TTTLTWEESNAY YWQPYALPL | 280 |
| ESPLTWEESSAL YWQPYALPL | 281 |
| ETPLTWEESNAY YWQPYALPL | 282 |
| EATFTWAESNAY YWQPYALPL | 283 |
| EALFTWKESTAY YWQPYALPL | 284 |
| STP-TWEESNAY YWQPYALPL | 285 |
| ETPFTWEESNAY YWQPYALPL | 286 |
| KAPFTWEESQAY YWQPYALPL | 287 |
| STSFTWEESNAY YWQPYALPL | 288 |
| DSTFTWEESNAY YWQPYALPL | 289 |
| YIPFTWEESNAY YWQPYALPL | 290 |
| QTAFTWEESNAY YWQPYALPL | 291 |
| ETLFTWEESNAT YWQPYALPL | 292 |
| VSSFTWEESNAY YWQPYALPL | 293 |
| QPYALPL | 294 |
| Py-1-NapPYQJYALPL | 295 |
| TANVSSFEWTPG YWQPYALPL | 296 |
| FEWTPGYWQPYALPL | 297 |
| FEWTPGYWQJYALPL | 298 |
| FEWTPGYYQJYALPL | 299 |
| ETPFTWEESNAYYWQPYALPL | 300 |
| FTWEESNAYYWQJYALPL | 301 |
| ADYL YWQPYA PVTLWV | 302 |
| GDVAE YWQPYA LPLTSL | 303 |
| SWTDYG YWQPYA LPISGL | 304 |
| FEWTPGYWQPYALPL | 305 |
| FEWTPGYWQJYALPL | 306 |
| FEWTPGWYQPYALPL | 307 |
| FEWTPGWYQJYALPL | 308 |
| FEWTPGYYQPYALPL | 309 |
| FEWTPGYYQJYALPL | 310 |

TABLE 4-continued

IL-1 antagonist peptide sequences

| Sequence/structure | SEQ ID NO: |
|---|---|
| TANVSSFEWTPGYWQPYALPL | 311 |
| SWTDYGYWQPYALPISGL | 312 |
| ETPFTWEESNAYYWQPYALPL | 313 |
| ENTYSPNWADSMYWQPYALPL | 314 |
| SVGEDHNFWTSEYWQPYALPL | 315 |
| DGYDRWRQSGERYWQPYALPL | 316 |
| FEWTPGYWQPYALPL | 317 |
| FEWTPGYWQPY | 318 |
| FEWTPGYWQJY | 319 |
| EWTPGYWQPY | 320 |
| FEWTPGWYQJY | 321 |
| AEWTPGYWQJY | 322 |
| FAWTPGYWQJY | 323 |
| FEATPGYWQJY | 324 |
| FEWAPGYWQJY | 325 |
| FEWTAGYWQJY | 326 |
| FEWTPAYWQJY | 327 |
| FEWTPGAWQJY | 328 |
| FEWTPGYAQJY | 329 |
| FEWTPGYWQJA | 330 |
| FEWTGGYWQJY | 331 |
| FEWTPGYWQJY | 332 |
| FEWTJGYWQJY | 333 |
| FEWTPecGYWQJY | 334 |
| FEWTPAibYWQJY | 335 |
| FEWTPSarWYQJY | 336 |
| FEWTSarGYWQJY | 337 |
| FEWTPNYWQJY | 338 |
| FEWTPVYWQJY | 339 |
| FEWTVPYWQJY | 340 |
| AcFEWTPGWYQJY | 341 |
| AcFEWTPGYWQJY | 342 |
| 1Nap-EWTPGYYQJY | 343 |
| YEWTPGYYQJY | 344 |
| FEWVPGYYQJY | 345 |
| FEWTPGYYQJY | 346 |
| FEWTPSYYQJY | 347 |
| FEWTPnYYQJY | 348 |
| SHLY-Nap-QPYSVQM | 349 |
| TLVY-Nap-QPYSLQT | 350 |
| RGDY-Nap-QPYSVQS | 351 |
| NMVY-Nap-QPYSIQT | 352 |
| VYWQPYSVQ | 353 |
| VY-Nap-QPYSVQ | 354 |
| TFVYWQJYALPL | 355 |
| FEWTPGYYQJ-Bpa | 356 |
| XaaFEWTPGYYQJ-Bpa | 357 |
| FEWTPGY-Bpa-QJY | 358 |
| AcFEWTPGY-Bpa-QJY | 359 |
| FEWTPG-Bpa-YQJY | 360 |
| AcFEWTPG-Bpa-YQJY | 361 |
| AcFE-Bpa-TPGYYQJY | 362 |
| AcFE-Bpa-TPGYYQJY | 363 |
| Bpa-EWTPGYYQJY | 364 |
| AcBpa-EWTPGYYQJY | 365 |
| VYWQPYSVQ | 366 |
| RLVYWQPYSVQR | 367 |
| RLVY-Nap-QPYSVQR | 368 |
| RLDYWQPYSVQR | 369 |
| RLVWFQPYSVQR | 370 |
| RLVYWQPYSIQR | 371 |
| DNSSWYDSFLL | 372 |
| DNTAWYESFLA | 373 |
| DNTAWYENFLL | 374 |
| PARE DNTAWYDSFLI WC | 375 |
| TSEY DNTTWYEKFLA SQ | 376 |
| SQIP DNTAWYQSFLL HG | 377 |
| SPFI DNTAWYENFLL TY | 378 |
| EQIY DNTAWYDHFLL SY | 379 |
| TPFI DNTAWYENFLL TY | 380 |
| TYTY DNTAWYERFLM SY | 381 |
| TMTQ DNTAWYENFLL SY | 382 |
| TI DNTAWYANLVQ TYPQ | 383 |
| TI DNTAWYERFLA QYPD | 384 |

TABLE 4-continued

IL-1 antagonist peptide sequences

| Sequence/structure | SEQ ID NO: |
|---|---|
| HI DNTAWYEMFLL TYTP | 385 |
| SQ DNTAWYENFLL SYKA | 386 |
| QI DNTAWYERFLL QYNA | 387 |
| NQ DNTAWYESFLL QYNT | 388 |
| TI DNTAWYENFLL NHNL | 389 |
| HY DNTAWYERFLQ QGWH | 390 |
| ETPFTWEESNAYYWQPYALPL | 391 |
| YIPFTWEESNAYYWQPYALPL | 392 |
| DGYDRWRQSGERYWQPYALPL | 393 |
| pY-1Nap-pY-QJYALPL | 394 |
| TANVSSFEWTPGYWQPYALPL | 395 |
| FEWTPGYWQJYALPL | 396 |
| FEWTPGYWQPYALPLSD | 397 |
| FEWTPGYYQJYALPL | 398 |
| FEWTPGYWQJY | 399 |
| AcFEWTPGYWQJY | 400 |
| AcFEWTPGYWYQJY | 401 |
| AcFEWTPGYYQJY | 402 |
| AcFEEWTPaYWQJY | 403 |
| AcFEWTPaWYQJY | 404 |
| AcFEWTPaYYQJY | 405 |
| FEWTPGYYQJYALPL | 406 |
| FEWTPGYWQJYALPL | 407 |
| FEWTPGWYQJYALPL | 408 |
| TANVSSFEWTPGYWQPYALPL | 409 |
| AcFEWTPGYWQJY | 410 |
| AcFEWTPGWYQJY | 411 |
| AcFEWTPGYYQJY | 412 |
| AcFEWTPAYWQJY | 413 |
| AcFEWTPAWYQJY | 414 |
| AcFEWTPAYYQJY | 415 |

TABLE 5

EPO-mimetic peptide sequences

| Sequence/structure | SEQ ID NO: |
|---|---|
| YXCXXGPXTWXCXP | 416 |
| YXCXXGPXTWXCXP-YXCXXGPXTWXCXP | 417 |
| YXCXXGPXTWXCXP-Λ-YXCXXGPXTWXCXP | 418 |
| YXCXXGPXTWXCXP-Λ-$\underset{\text{YXCXXGPXTWXCXP-Λ-}}{\overset{\text{(ε-amine)}}{\underset{\text{(α-amine)}}{\text{K}\!-\!\beta A}}}$ | 419 |
| GGTYSCHFGPLTWVCKPQGG | 420 |
| GGDYHCRMGPLTWVCKPLGG | 421 |
| GGVYACRMGPITWVCSPLGG | 422 |
| VGNYMCHFGPITWVCRPGGG | 423 |
| GGLYLCRFGPVTWDCGYKGG | 424 |
| GGTYSCHFGPLTWVCKPQGG-GGTYSCHFGPLTWVCKPQGG | 425 |
| GGTYSCHFGPLTWVCKPQGG-Λ-GGTYSCHFGPLTWVCKPQGG | 426 |
| GGTYSCHFGPLTWVCKPQGGSSK | 427 |
| GGTYSCHFGPLTWVCKPQGGSSK-GGTYSCHFGPLTWVCKPQGGSSK | 428 |
| GGTYSCHFGPLTWVCKPQGGSSK-Λ-GGTYSCHFGPLTWVCKPQGGSSK | 429 |
| GGTYSCHFGPLTWVCKPQGGSS$\underset{\text{GGTYSCHFGPLTWVCKPQGGSS}}{\overset{\text{(ε-amine)}}{\underset{\text{(α-amine)}}{\text{K}\!-\!\beta A}}}$ | 430 |
| GGTYSCHFGPLTWVCKPQGGSSK(Λ-biotin) | 431 |
| CX$_4$X$_5$GPX$_6$TWX$_7$C | 432 |
| GGTYSCHGPLTWVCKPQGG | 433 |
| VGNYMAHMGPITWVCRPGG | 434 |
| GGPHHVYACRMGPLTWIC | 435 |
| GGTYSCHFGPLTWVCKPQ | 436 |
| GGLYACHMGPMTWVCQPLRG | 437 |
| TIAQYICYMGPETWECRPSPKA | 438 |
| YSCHFGPLTWVCK | 439 |
| YCHFGPLTWVC | 440 |
| X$_3$X$_4$X$_5$GPX$_6$TWX$_7$X$_8$ | 441 |
| YX$_2$X$_3$X$_4$X$_5$GPX$_6$TWX$_7$X$_8$ | 442 |
| X$_1$YX$_2$X$_3$X$_4$X$_5$GPX$_6$TWX$_7$X$_8$X$_9$X$_{10}$X$_{11}$ | 443 |
| X$_1$YX$_2$CX$_4$X$_5$GPX$_6$TWX$_7$CX$_9$X$_{10}$X$_{11}$ | 444 |
| GGLYLCRFGPVTWDCGYKGG | 445 |
| GGTYSCHFGPLTWVCKPQGG | 446 |
| GGDYHCRMGPLTWVCKPLGG | 447 |
| VGNYMCHFGPITWVCRPGGG | 448 |
| GGVYACRMGPITWVCSPLGG | 449 |
| VGNYMAHMGPITWVCRPGG | 450 |
| GGTYSCHFGPLTWVCKPQ | 451 |
| GGLYACHMGPMTWVCQPLRG | 452 |
| TIAQYICYMGPETWECRPSPKA | 453 |
| YSCHFGPLTWVCK | 454 |
| YCHFGPLTWVC | 455 |
| SCHFGPLTWVCK | 456 |
| (AX$_2$)$_n$X$_3$X$_4$X$_5$GPX$_6$TWX$_7$X$_8$ | 457 |
| X$_n$CX$_1$X$_2$GWVGX$_3$CX$_4$X$_5$WX$_C$ | 458 |

TABLE 6

TPO-mimetic peptide sequences

| Sequence/structure | SEQ ID NO: |
|---|---|
| IEGPTLRQWLAARA | 459 |
| IEGPTLRQWLAAKA | 460 |
| IEGPTLREWLAARA | 461 |

TABLE 6-continued

TPO-mimetic peptide sequences

| Sequence/structure | SEQ ID NO: |
|---|---|
| IEGPTLRQWLAARA-Λ-IEGPTLRQWLAARA | 462 |
| IEGPTLRQWLAAKA-Λ-IEGPTLRQWLAAKA | 463 |
| IEGPTLRQCLAARA-Λ-IEGPTLRQCLAARA | 464 |
| IEGPTLRQWLAARA-Λ-K(BrAc)-Λ-IEGPTLRQWLAARA | 465 |
| IEGPTLRQWLAARA-Λ-K(PEG)-Λ-IEGPTLRQWLAARA | 466 |
| IEGPTLRQCLAARA-Λ-IEGPTLRQWLAARA / IEGPTLRQCLAARA-Λ-IEGPTLRQWLAARA | 467 |
| IEGPTLRQWLAARA-Λ-IEGPTLRQCLAARA / IEGPTLRQWLAARA-Λ-IEGPTLRQCLAARA | 468 |
| VRDQIXXXL | 469 |
| TLREWL | 470 |
| GRVRDQVAGW | 471 |
| GRVKDQIAQL | 472 |
| GVRDQYSWAL | 473 |
| ESVREQVMKY | 474 |
| SVRSQISASL | 475 |
| GVRETVYRHM | 476 |
| GVREVIVMHML | 477 |
| GRVRDQIWAAL | 478 |
| AGVRDQILIWL | 479 |
| GRVRDQIMLSL | 480 |
| GRVRDQI(X)$_3$L | 481 |
| CTLRQWLQGC | 482 |
| CTLQEFLEGC | 483 |
| CTRTEWLHGC | 484 |
| CTLREWLHGGFC | 485 |
| CTLREWVFAGLC | 486 |
| CTLRQWLILLGMC | 487 |
| CTLAEFLASGVEQC | 488 |
| CSLQEFLSHGGYVC | 489 |
| CTLREFLDPTTAVC | 490 |
| CTLKEWLVSHEVWC | 491 |
| CTLREWL(X)$_{2-6}$C | 492 |
| REGPTLRQWM | 493 |
| EGPTLRQWLA | 494 |
| ERGPFWAKAC | 495 |
| REGPRCVMWM | 496 |
| CGTEGPTLSTWLDC | 497 |
| CEQDGPTLLEWLKC | 498 |
| CELVGPSLMSWLTC | 499 |
| CLTGPFVTQWLYEC | 500 |
| CRAGPTLLEWLTLC | 501 |
| CADGPTLREWISFC | 502 |
| C(X)$_{1-2}$EGPTLREWL(X)$_{1-2}$C | 503 |
| GGCTLREWLHGGFCGG | 504 |
| GGCADGPTLREWISFCGG | 505 |
| GNADGPTLRQWLEGRRPKN | 506 |
| LAIEGPTLRQWLHGNGRDT | 507 |
| HGRVGPTLREWKTQVATKK | 508 |
| TIKGPTLRQWLKSREHTS | 509 |
| ISDGPTLKEWLSVTRGAS | 510 |
| SIEGPTLREWLTSRTPHS | 511 |

TABLE 7

G-CSF-mimetic peptide sequences

| Sequence/structure | SEQ ID NO: |
|---|---|
| EEDCK | 512 |
| EEDCK / EEDCK | 513 |
| EEDσK | 514 |
| EEDσK / EEDσK | 515 |
| PGluEDσK | 516 |
| pGluEDσK / pGluEDσK | 517 |
| PicSDσK | 518 |
| PicSDσK / PicSDσK | 519 |
| EEDCK-Λ-EEDCK | 520 |
| EEDXK-Λ-EEDXK | 521 |

TABLE 8

TNF-antagonist peptide sequences

| Sequence/structure | SEQ ID NO: |
|---|---|
| YCFTASENHCY | 522 |
| YCFTNSENHCY | 523 |
| YCFTRSENHCY | 524 |
| FCASENHCY | 525 |
| YCASENHCY | 526 |
| FCNSENHCY | 527 |
| FCNSENRCY | 528 |
| FCNSVENRCY | 529 |
| YCSQSVSNDCF | 530 |
| FCVSNDRCY | 531 |
| YCRKELGQVCY | 532 |
| YCKEPGQCY | 533 |
| YCRKEMGCY | 534 |
| FCRKEMGCY | 535 |
| YCWSQNLCY | 536 |
| YCELSQYLCY | 537 |
| YCWSQNYCY | 538 |
| YCWSQYLCY | 539 |
| DFLPHYKNTSLGHRP | 540 |
| AA$_1$-AB$_1$\\_AC / AA$_2$-AB$_2$ | NR |

TABLE 9

Integrin-binding peptide sequences

| Sequence/structure | SEQ ID NO: |
|---|---|
| $RX_1ETX_2WX_3$ | 541 |
| $RX_1ETX_2WX_3$ | 542 |
| RGDGX | 543 |
| CRGDGXC | 544 |
| $CX_1X_2RLDX_3X_4C$ | 545 |
| CARRLDAPC | 546 |
| CPSRLDSPC | 547 |
| $X_1X_2X_3RGDX_4X_5X_6$ | 548 |
| $CX_2CRGDCX_5C$ | 549 |
| CDCRGDCFC | 550 |
| CDCRGDCLC | 551 |
| CLCRGDCIC | 552 |
| $X_1X_2DDX_4X_5X_7X_8$ | 553 |
| $X_1X_2X_3DDX_4X_5X_6X_7X_8$ | 554 |
| CWDDGWLC | 555 |
| CWDDLWWLC | 556 |
| CWDDGLMC | 557 |
| CWDDGWMC | 558 |
| CSWDDGWLC | 559 |
| CPDDLWWLC | 560 |
| NGR | NR |
| GSL | NR |
| RGD | NR |
| CGRECPRLCQSSC | 561 |
| CNGRCVSGCAGRC | 562 |
| CLSGSLSC | 563 |
| RGD | NR |
| NGR | NR |
| GSL | NR |
| NGRAHA | 564 |
| CNGRC | 565 |
| CDCRGDCFC | 566 |
| CGSLVRC | 567 |
| DLXXL | 568 |
| RTDLDSLRTYTL | 569 |
| RTDLDSLRTY | 570 |
| RTDLDSLRT | 571 |
| RTDLDSLR | 572 |
| GDLDLLKLRLTL | 573 |
| GDLHSLRQLLSR | 574 |
| RDDLHMLRLQLW | 575 |
| SSDLHALKKRYG | 576 |
| RGDLKQLSELTW | 577 |
| RGDLAALSAPPV | 578 |

TABLE 10

Selectin antagonist peptide sequences

| Sequence/structure | SEQ ID NO: |
|---|---|
| DITWDQLWDLMK | 579 |
| DITWDELWKIMN | 580 |
| DYTWFELWDMMQ | 581 |
| QITWAQLWNMMK | 582 |
| DMTWHDLWTLMS | 583 |
| DYSWHDLWEMMS | 584 |
| EITWDQLWEVMN | 585 |
| HVSWEQLWDIMN | 586 |
| HITWDQLWRIMT | 587 |
| RNMSWLELWEHMK | 588 |
| AEWTWDQLWHVMNPAESQ | 589 |
| HRAEWLALWEQMSP | 590 |
| KKEDWLALWRIMSV | 591 |
| ITWDQLWDLMK | 592 |
| DITWDQLWDLMK | 593 |
| DITWDQLWDLMK | 594 |
| DITWDQLWDLMK | 595 |
| CQNRYTDLVAIQNKNE | 596 |
| AENWADNEPNNKRNNED | 597 |
| RKNNKTWTWVGTKKALTNE | 598 |
| KKALTNEAENWAD | 599 |
| CQXRYTDLVAIQNKXE | 600 |
| RKXNXXWTWVGTXKXLTEE | 601 |
| AENWADGEPNNKXNXED | 602 |
| CXXXYTXLVAIQNKXE | 603 |
| RKXXXXWXWVGTXKXLTXE | 604 |

TABLE 10-continued

Selectin antagonist peptide sequences

| Sequence/structure | SEQ ID NO: |
|---|---|
| AXNWXXXEPNNXXXED | 605 |
| XKXKTXEAXNWXX | 606 |

TABLE 11

Antipathogenic peptide sequences

| Sequence/structure | SEQ ID NO: |
|---|---|
| GFFALIPKIISSPLFKTLLSAVGSALSSSGGQQ | 607 |
| GFFALIPKIISSPLFKTLLSAVGSALSSSGGQE | 608 |
| GFFALIPKIISSPLFKTLLSAV | 609 |
| GFFALIPKIISSPLFKTLLSAV | 610 |
| KGFFALIPKIISSPLFKTLLSAV | 611 |
| KKGFFALIPKIISSPLFKTLLSAV | 612 |
| KKGFFALIPKIISSPLFKTLLSAV | 613 |
| GFFALIPKIIS | 614 |
| GIGAVLKVLTTGLPALISWIKRKRQQ | 615 |
| GIGAVLKVLTTGLPALISWIKRKRQQ | 616 |
| GIGAVLKVLTTGLPALISWIKRKRQQ | 617 |
| GIGAVLKVLTTGLPALISWIKR | 618 |
| AVLKVLTTGLPALISWIKR | 619 |
| KLLLLLKLLLLK | 620 |
| KLLLKLLLKLLK | 621 |
| KLLLKLKLKLLK | 622 |
| KKLLKLKLKLKK | 623 |
| KLLLKLLLKLLK | 624 |
| KLLLKLKLKLLK | 625 |
| KLLLLK | 626 |
| KLLLKLLK | 627 |
| KLLLKLKLKLLK | 628 |
| KLLLKLKLKLLK | 629 |
| KLLLKLKLKLLK | 630 |
| KAAAKAAAKAAK | 631 |
| KVVVKVVVKVVK | 632 |
| KVVVKVKVKVVK | 633 |
| KVVVKVKVKVK | 634 |
| KVVVKVKVKVVK | 635 |
| KLILKL | 636 |
| KVLHLL | 637 |

TABLE 11-continued

Antipathogenic peptide sequences

| Sequence/structure | SEQ ID NO: |
|---|---|
| LKLRLL | 638 |
| KPLHLL | 639 |
| KLILKLVR | 640 |
| KVFHLLHL | 641 |
| HKFRILKL | 642 |
| KPFHILHL | 643 |
| KIIIKIKIKIIK | 644 |
| KIIIKIKIKIIK | 645 |
| KIIIKIKIKIIK | 646 |
| KLPIKIKIKIPK | 647 |
| KIPIKIKIKIVK | 648 |
| RIIIRIRIRIIR | 649 |
| RIIIRIRIRIIR | 650 |
| RIIIRIRIRIIR | 651 |
| RIVIRIRIRLIR | 652 |
| RIIVRIRLRIIR | 653 |
| RIGIRLRVRIIR | 654 |
| KIVIRIRIRLIR | 655 |
| RIAVKWRLRFIK | 656 |
| KIGWKLRVRIIR | 657 |
| KKIGWLIIRVRR | 658 |
| RIVIRIRIRLIRIR | 659 |
| RIIVRIRLRIIRVR | 660 |
| RIGIRLRVRIIRRV | 661 |
| KIVIRIRARLIRIRIR | 662 |
| RIIVKIRLRIIKKIRL | 663 |
| KIGIKARVRIIRVKII | 664 |
| RIIVHIRLRIIHHIRL | 665 |
| HIGIKAHVRIIRVHII | 666 |
| RIYVKIHLRYIKKIRL | 667 |
| KIGHKARVHIIRYKII | 668 |
| RIYVKPHPRYIKKIRL | 669 |
| KPGHKARPHIIRYKII | 670 |
| KIVIRIRIRLIRIRIRKIV | 671 |
| RIIVKIRLRIIKKIRLIKK | 672 |
| KIGWKLRVRIIRVKIGRLR | 673 |
| KIVIRIRIRLIRIRIRKIVKVKRIR | 674 |

TABLE 11-continued

Antipathogenic peptide sequences

| Sequence/structure | SEQ ID NO: |
|---|---|
| RFAVKIRLRI1KKIRLIKKIRKRVIK | 675 |
| KAGWKLRVRIIRVKIGRLRKIGWKKRVRIK | 676 |
| RIYVKPHPRYIKKIRL | 677 |
| KPGHKARPHIIRYKII | 678 |
| KIVIRIRIRLIRIRIRKIV | 679 |
| RIIVKIRLRIIKKIRLIKK | 680 |
| RIYVSKISIYIKKIRL | 681 |
| KIVIFTRIRLTSIRIRSIV | 682 |
| KPIHKARPTIIRYKMI | 683 |
| cyclicCKGFFALIPKIISSPLFKTLLSAVC | 684 |
| CKKGFFALIPKIISSPLFKTLLSAVC | 685 |
| CKKKGFFALIPKIISSPLFKTLLSAVC | 686 |
| CyclicCRIVIRIRIRLIRIRC | 687 |
| CyclicCKPGHKARPHIIRYKIIC | 688 |
| CyclicCRFAVKIRLRIIKKIRLIKKIRKRVIKC | 689 |
| KLLLKLLL KLLKC | 690 |
| KLLLKLLLKLLK | 691 |
| KLLLKLKLKLLKC | 692 |
| KLLLKLLLKLLK | 693 |

TABLE 12

VIP-mimetic peptide sequences

| Sequence/Structure | SEQ ID NO: |
|---|---|
| HSDAVFYDNYTR LRKQMAVKKYLN SILN | 694 |
| Nle HSDAVFYDNYTR LRKQMAVKKYLN SILN | 695 |
| $X_1 X_1' X_1'' X_2$ | 696 |
| $X_3 S X_4 LN$ | 697 |
| 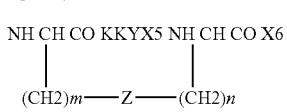 | 698 |
| KKYL | 699 |
| NSILN | 700 |
| KKYL | 701 |
| KKYA | 702 |
| AVKKYL | 703 |
| NSILN | 704 |
| KKYV | 705 |
| SILauN | 706 |
| KKYLNle | 707 |
| NSYLN | 708 |
| NSIYN | 709 |
| KKYLPPNSILN | 710 |
| LauKKYL | 711 |
| CapKKYL | 712 |
| KYL | 713 |
| KKYNle | 714 |
| VKKYL | 715 |

TABLE 12-continued

VIP-mimetic peptide sequences

| Sequence/Structure | SEQ ID NO: |
|---|---|
| LNSILN | 716 |
| YLNSILN | 717 |
| KKYLN | 718 |
| KKYLNS | 719 |
| KKYLNSI | 720 |
| KKYLNSIL | 721 |
| KKYL | 722 |
| KKYDA | 723 |
| AVKKYL | 724 |
| NSILN | 725 |
| KKYV | 726 |
| SILauN | 727 |
| NSYLN | 728 |
| NSIYN | 729 |
| KKYLNle | 730 |
| KXYLPPNSILN | 731 |
| KKYL | 732 |
| KKYDA | 733 |
| AVKKYL | 734 |
| NSILN | 735 |
| KKYV | 736 |
| SILauN | 737 |
| LauKKYL | 738 |
| CapKKYL | 739 |
| KYL | 740 |
| KYL | 741 |
| KKYNle | 742 |
| VKKYL | 743 |
| LNSILN | 744 |
| YLNSILN | 745 |
| KKYLNle | 746 |
| KKYLN | 747 |
| KKYLNS | 748 |
| KKYLNSI | 749 |
| KKYLNSIL | 750 |
| KKKYLD | 751 |
| cyclicCKKYLC | 752 |
| CKKYLK<br>/     \<br>S—CH$_2$—CO | 753 |
| KKYA | 754 |
| WWTDTGLW | 755 |
| WWTDDGLW | 756 |
| WWDTRGLWVWTI | 757 |
| FWGNDGIWLESG | 758 |
| DWDQFGLWRGAA | 759 |
| RWDDNGLWVVVL | 760 |
| SGMWSHYGIWMG | 761 |
| GGRWDQAGLWVA | 762 |
| KLWSEQGIWMGE | 763 |
| CWSMHGLWLC | 764 |
| GCWDNTGIWVPC | 765 |
| DWDTRGLWVY | 766 |
| SLWDENGAWI | 767 |
| KWDDRGLWMH | 768 |
| QAWNERGLWT | 769 |
| QWDTRGLWVA | 770 |
| WNVHGIWQE | 771 |
| SWDTRGLWVE | 772 |
| DWDTRGLWVA | 773 |
| SWGRDGLWIE | 774 |
| EWTDNGLWAL | 775 |
| SWDEKGLWSA | 776 |
| SWDSSGLWMD | 777 |

TABLE 13

Mdm/hdm antagonist peptide sequences

| Sequence/structure | SEQ ID NO: |
|---|---|
| TFSDLW | 778 |
| QETFSDLWKLLP | 779 |
| QPTFSDLWKLLP | 780 |
| QETFSDYWKLLP | 781 |
| QPTFSDYWKLLP | 782 |
| MPRFMDYWEGLN | 783 |
| VQNFIDYWTQQF | 784 |
| TGPAFTHYWATF | 785 |
| IDRAPTFRDHWFALV | 786 |
| PRPALVFADYWETLY | 787 |
| PAFSRFWSDLSAGAH | 788 |
| PAFSRFWSKLSAGAH | 789 |
| PXFXDYWXXL | 790 |
| QETFSDLWKLLP | 791 |
| QPTFSDLWKLLP | 792 |
| QETFSDYWKLLP | 793 |
| QPTFSDYWKLLP | 794 |

TABLE 14

Calmodulin antagonist peptide sequences

| Sequence/structure | SEQ ID NO: |
|---|---|
| SCVKWGKKEFCGS | 795 |
| SCWKYWGKECGS | 796 |
| SCYEWGKLRWCGS | 797 |
| SCLRWGKWSNCGS | 798 |
| SCWRWGKYQICGS | 799 |
| SCVSWGALKLCGS | 800 |
| SCIRWGQNTFCGS | 801 |
| SCWQWGNLKICGS | 802 |
| SCVRWGQLSICGS | 803 |
| LKKFNARRKLKGAILTTMLAK | 804 |
| RRWKKNFIAVSAANRFKK | 805 |
| RKWQKTGHAVRAIGRLSS | 806 |
| INLKALAALAKKIL | 807 |
| KIWSILAPLGTTLVKLVA | 808 |
| LKKLLKLLKKLLKL | 809 |
| LKWKKLLKLLKKLLKKLL | 810 |

TABLE 14-continued

Calmodulin antagonist peptide sequences

| Sequence/structure | SEQ ID NO: |
|---|---|
| AEWPSLTEIKTLSHFSV | 811 |
| AEWPSPTRVISTTYFGS | 812 |
| AELAHWPPVKTVLRSFT | 813 |
| AEGSWLQLLNLMKQMNN | 814 |
| AEWPSLTEIK | 815 |

TABLE 15

Mast cell antagonists/Mast cell protease inhibitor peptide sequences

| Sequence/structure | SEQ ID NO: |
|---|---|
| SGSGVLKRPLPILPVTR | 816 |
| RWLSSRPLPPLPLPPRT | 817 |
| GSGSYDTLALPSLPLHPMSS | 818 |
| GSGSYDTRALPSLPLHPMSS | 819 |
| GSGSSGVTMYPKLPPHWSMA | 820 |
| GSGSSGVRMYPKLPPHWSMA | 821 |
| GSGSSSMRMVPTIPGSAKHG | 822 |
| RNR | NR |
| QT | NR |
| RQK | NR |
| NRQ | NR |
| RQK | NR |
| RNRQKT | 823 |
| RNRQ | 824 |
| RNRQK | 825 |
| NRQKT | 826 |
| RQKT | 827 |

TABLE 16

SH3 antagonist peptide sequences

| Sequence/structure | SEQ ID NO: |
|---|---|
| RPLPPLP | 828 |
| RELPPLP | 829 |
| SPLPPLP | 830 |
| GPLPPLP | 831 |
| RPLPIPP | 832 |

TABLE 16-continued

SH3 antagonist peptide sequences

| Sequence/structure | SEQ ID NO: |
|---|---|
| RPLPIPP | 833 |
| RRLPPTP | 834 |
| RQLPPTP | 835 |
| RPLPSRP | 836 |
| RPLPTRP | 837 |
| SRLPPLP | 838 |
| RALPSPP | 839 |
| RRLPRTP | 840 |
| RPVPPIT | 841 |
| ILAPPVP | 842 |
| RPLPMLP | 843 |
| RPLPILP | 844 |
| RPLPSLP | 845 |
| RPLPSLP | 846 |
| RPLPMIP | 847 |
| RPLPLIP | 848 |
| RPLPPTP | 849 |
| RSLPPLP | 850 |
| RPQPPPP | 851 |
| RQLPIPP | 852 |
| XXXRPLPPLPXP | 853 |
| XXXRPLPPIPXX | 854 |
| XXXRPLPPLPXX | 855 |
| RXXRPLPPLPXP | 856 |
| RXXRPLPPLPPP | 857 |
| PPPYPPPPIPXX | 858 |
| PPPYPPPPVPXX | 859 |
| LXXRPLPΨP | 860 |
| ΨXXRPLPXLP | 861 |
| PPXΘXPPPΨP | 862 |
| +PPΨPXKPXWL | 863 |
| RPXΨPΨR+SXP | 864 |
| PPVPPRPXXTL | 865 |
| ΨPΨLPΨK | 866 |
| +ΘDXPLPXLP | 867 |

TABLE 17

Somatostatin or cortistatin mimetic peptide sequences

| Sequence/structure | SEQ ID NO: |
|---|---|
| $X^1$-$X^2$-Asn-Phe-Phe-Trp-Lys-Thr-Phe-$X^3$-Ser-$X^4$ | 868 |
| Asp Arg Met Pro Cys Arg Asn Phe Phe Trp Lys Thr Phe Ser Ser Cys | 869 |
| Met Pro Cys Arg Asn Phe Phe Trp Lys Thr Phe Ser Ser Cys Lys | 870 |
| Cys Arg Asn Phe Phe Trp Lys Thr Phe Ser Ser Cys Lys | 871 |
| Asp Arg Met Pro Cys Arg Asn Phe Phe Trp Lys Thr Phe Ser Ser Cys | 872 |
| Met Pro Cys Lys Asn Phe Phe Trp Lys Thr Phe Ser Ser Cys | 873 |
| Cys Arg Asn Phe Phe Trp Lys Thr Phe Ser Ser Cys | 874 |
| Asp Arg Met Pro Cys Lys Asn Phe Phe Trp Lys Thr Phe Ser Ser Cys | 875 |
| Met Pro Cys Lys Asn Phe Phe Trp Lys Thr Phe Ser Ser Cys Lys | 876 |
| Cys Lys Asn Phe Phe Trp Lys Thr Phe Ser Ser Cys Lys | 877 |
| Asp Arg Met Pro Cys Lys Asn Phe Phe Trp Lys Thr Phe Ser Ser Cys | 878 |
| Met Pro Cys Lys Asn Phe Phe Trp Lys Thr Phe Ser Ser Cys | 879 |
| Cys Lys Asn Phe Phe Trp Lys Thr Phe Ser Ser Cys | 880 |
| Asp Arg Met Pro Cys Arg Asn Phe Phe Trp Lys Thr Phe Thr Ser Cys Lys | 881 |
| Met Pro Cys Arg Asn Phe Phe Trp Lys Thr Phe Thr Ser Cys Lys | 882 |
| Cys Arg Asn Phe Phe Trp Lys Thr Phe Thr Ser Cys Lys | 883 |
| Asp Arg Met Pro Cys Arg Asn Phe Phe Trp Lys Thr Phe Thr Ser Cys | 884 |
| Met Pro Cys Arg Asn Phe Phe Trp Lys Thr Phe Thr Ser Cys | 885 |
| Cys Arg Asn Phe Phe Trp Lys Thr Phe Thr Ser Cys | 886 |
| Asp Arg Met Pro Cys Lys Asn Phe Phe Trp Lys Thr Phe Thr Ser Cys Lys | 887 |
| Met Pro Cys Lys Asn Phe Phe Trp Lys Thr Phe Thr Ser Cys Lys | 888 |
| Cys Lys Asn Phe Phe Trp Lys Thr Phe Thr Ser Cys Lys | 889 |
| Asp Arg Met Pro Cys Lys Asn Phe Phe Trp Lys Thr Phe Thr Ser Cys | 890 |
| Met Pro Cys Lys Asn Phe Phe Trp Lys Thr Phe Thr Ser Cys | 891 |
| Cys Lys Asn Phe Phe Trp Lys Thr Phe Thr Ser Cys | 892 |

TABLE 18

UKR antagonist peptide sequences

| Sequence/structure | SEQ ID NO: |
|---|---|
| AEPMPHSLNFSQYLWYT | 893 |
| AEHTYSSLWDTYSPLAF | 894 |
| AELDLWMRHYPLSFSNR | 895 |
| AESSLWTRYAWPSMPSY | 896 |
| AEWHPGLSFGSYLWSKT | 897 |
| AEPALLNWSFFFNPGLH | 898 |
| AEWSFYNLHLPEPQTIF | 899 |
| AEPLDLWSLYSLPPLAM | 900 |
| AEPTLWQLYQFP

TABLE 19-continued

Macrophage and/or T-cell inhibiting peptide sequences

| Sequence/structure | SEQ ID NO: |
|---|---|
| Arg-Glu | NR |
| Arg-Gly | NR |
| Arg-His | NR |
| Arg-Ile | NR |
| Arg-Leu | NR |
| Arg-Lys | NR |
| Arg-Met | NR |
| Arg-Phe | NR |
| Arg-Pro | NR |
| Arg-Ser | NR |
| Arg-Thr | NR |
| Arg-Trp | NR |
| Arg-Tyr | NR |
| Arg-Val | NR |
| Arg-Glu-Ala | NR |
| Arg-Glu-Asn | NR |
| Arg-Glu-Asp | NR |
| Arg-Glu-Cys | NR |
| Arg-Glu-Gln | NR |
| Arg-Glu-Glu | NR |
| Arg-Glu-Gly | NR |
| Arg-Glu-His | NR |
| Arg-Glu-Ile | NR |
| Arg-Glu-Leu | NR |
| Arg-Glu-Lys | NR |
| Arg-Glu-Met | NR |
| Arg-Glu-Phe | NR |
| Arg-Glu-Pro | NR |
| Arg-Glu-Ser | NR |
| Arg-Glu-Thr | NR |
| Arg-Glu-Trp | NR |
| Arg-Glu-Tyr | NR |
| Arg-Glu-Val | NR |
| Ala-Arg-Glu | NR |
| Arg-Arg-Glu | NR |
| Asn-Arg-Glu | NR |
| Asp-Arg-Glu | NR |
| Cys-Arg-Glu | NR |
| Gln-Arg-Glu | NR |
| Glu-Arg-Glu | NR |
| Gly-Arg-Glu | NR |
| His-Arg-Glu | NR |
| Ile-Arg-Glu | NR |
| Leu-Arg-Glu | NR |
| Lys-Arg-Glu | NR |
| Met-Arg-Glu | NR |
| Phe-Arg-Glu | NR |
| Pro-Arg-Glu | NR |
| Ser-Arg-Glu | NR |
| Thr-Arg-Glu | NR |
| Trp-Arg-Glu | NR |
| Tyr-Arg-Glu | NR |
| Val-Arg-Glu | NR |
| Glu-Arg-Ala, | NR |
| Glu-Arg-Arg | NR |
| Glu-Arg-Asn | NR |
| Glu-Arg-Asp | NR |
| Glu-Arg-Cys | NR |
| Glu-Arg-Gln | NR |
| Glu-Arg-Gly | NR |
| Glu-Arg-His | NR |
| Glu-Arg-Ile | NR |
| Glu-Arg-Leu | NR |
| Glu-Arg-Lys | NR |
| Glu-Arg-Met | NR |
| Glu-Arg-Phe | NR |
| Glu-Arg-Pro | NR |
| Glu-Arg-Ser | NR |
| Glu-Arg-Thr | NR |
| Glu-Arg-Trp | NR |
| Glu-Arg-Tyr | NR |
| Glu-Arg-Val | NR |

TABLE 20

Additional Exemplary Pharmacologically Active Peptides

| Sequence/structure | SEQ ID NO: | Activity |
| --- | --- | --- |
| VEPNCDIHVMWEWECFERL | 915 | VEGF-antagonist |
| GERWCFDGPLTWVCGEES | 916 | VEGF-antagonist |
| RGWVEICVADDNGMCVTEAQ | 917 | VEGF-antagonist |
| GWDECDVARMWEWECFAGV | 918 | VEGF-antagonist |
| GERWCFDGPRAWVCGWEI | 919 | VEGF-antagonist |
| EELWCFDGPRAWVCGYVK | 920 | VEGF-antagonist |
| RGWVEICAADDYGRCLTEAQ | 921 | VEGF-antagonist |
| RGWVEICESDVWGRCL | 922 | VEGF-antagonist |
| RGWVEICESDVWGRCL | 923 | VEGF-antagonist |
| GGNECDIARMWEWECFERL | 924 | VEGF-antagonist |
| RGWVEICAADDYGRCL | 925 | VEGF-antagonist |
| CTTHWGFTLC | 926 | MMP inhibitor |
| CLRSGXGC | 927 | MMP inhibitor |
| CXXHWGFXXC | 928 | MMP inhibitor |
| CXPXC | 929 | MMP inhibitor |
| CRRHWGFEFC | 930 | MMP inhibitor |
| STTHWGFTLS | 931 | MMP inhibitor |
| CSLHWGFWWC | 932 | CTLA4-mimetic |
| GFVCSGIFAVGVGRC | 933 | CTLA4-mimetic |
| APGVRLGCAVLGRYC | 934 | CTLA4-mimetic |
| LLGRMK | 935 | Antiviral (HBV) |
| ICVVQDWGHHRCTAGHMANLTSHASAI | 936 | C3b antagonist |
| ICVVQDWGHHRCT | 937 | C3b antagonist |
| CVVQDWGHHAC | 938 | C3b antagonist |
| STGGFDDVYDWARGVSSALTTTLVATR | 939 | Vinculin-binding |
| STGGFDDVYDWARRVSSALTTTLVATR | 940 | Vinculin-binding |
| SRGVNFSEWLYDMSAAMKEASNVFPSRRSR | 941 | Vinculin-binding |
| SSQNWDMEAGVEDLTAAMLGLLSTIHSSSR | 942 | Vinculin-binding |
| SSPSLYTQFLVNYESAATRIQDLLIASRPSR | 943 | Vinculin-binding |
| SSTGWVDLLGALQRAADATRTSIPPSLQNSR | 944 | Vinculin-binding |
| DVYTKKELIECARRVSEK | 945 | Vinculin-binding |
| EKGSYYPGSGIAQFHIDYNNVS | 946 | C4BP-binding |
| SGIAQFHIDYNNVSSAEGWHVN | 947 | C4BP-binding |
| LVTVEKGSYYPGSGIAQFHIDYNNVSSAEGWHVN | 948 | C4BP-binding |
| SGIAQFHIDYNNVS | 949 | C4BP-binding |
| LLGRMK | 950 | anti-HBV |
| ALLGRMKG | 951 | anti-HBV |
| LDPAFR | 952 | anti-HBV |
| CXXRGDC | 953 | Inhibition of platelet aggregation |
| RPLPPLP | 954 | Src antagonist |
| PPVPPR | 955 | Src antagonist |
| XFXDXWXXLXX | 956 | Anti-cancer (particularly for sarcomas) |
| KACRRLFGPVDSEQLSRDCD | 957 | p16-mimetic |
| RERWNFDFVTETPLEGDFAW | 958 | p16-mimetic |
| NRRQTSMTDFYHSNRRLIFS | 959 | p16-mimetic |
| TSMTDFYHSNRRLIFSNRKP | 960 | p16-mimetic |
| RRLIF | 961 | p16-mimetic |
| KRRQTSATDFYHSNRRLIFSRQIKIWFQNRRMKWKK | 962 | p16-mimetic |
| KRRLIFSNRQIK1WFQNRRMKWKK | 963 | p16-mimetic |
| Asn Gln Gly Arg His Phe Cys Gly Gly Ala Leu Ile His Ala Arg Phe Val Met Thr Ala Ala Ser Cys Phe Gln | 964 | CAP37 mimetic/LPS binding |

TABLE 20-continued

Additional Exemplary Pharmacologically Active Peptides

| Sequence/structure | SEQ ID NO: | Activity |
|---|---|---|
| Arg His Phe Cys Gly Gly Ala Leu Ile His Ala Arg Phe Val Met Thr Ala Ala Ser Cys | 965 | CAP37 mimetic/LPS binding |
| Gly Thr Arg Cys Gln Val Ala Gly Trp Gly Ser Gln Arg Ser Gly Gly Arg Leu Ser Arg Phe Pro Arg Phe Val Asn Val | 966 | CAP37 mimetic/LPS binding |
| WHWRHRIPLQLAAGR | 967 | carbohydrate (GD1 alpha) mimetic |
| LKTPRV | 968 | β2GPI Ab binding |
| NTLKTPRV | 969 | β2GPI Ab binding |
| NTLKTPRVGGC | 970 | β2GPI Ab binding |
| KDKATF | 971 | β2GPI Ab binding |
| KDKATFGCHD | 972 | β2GPI Ab binding |
| KDKATFGCHDGC | 973 | β2GPI Ab binding |
| TLRVYK | 974 | β2GPI Ab binding |
| ATLRVYKGG | 975 | β2GPI Ab binding |
| CATLRVYKGG | 976 | β2GPI Ab binding |
| INLKALAALAKKIL | 977 | Membrane-transporting |
| GWT | NR | Membrane-transporting |
| GWTLNSAGYLLG | 978 | Membrane-transporting |
| GWTLNSAGYLLGKINLKALAALAKKIL | 979 | Membrane-transporting |
| CVHAYRS | 980 | Antiproliferative, antiviral |
| CVHAYRA | 981 | Antiproliferative, antiviral |
| CVHAPRS | 982 | Antiproliferative, antiviral |
| CYHAPRA | 983 | Antiproliferative, antiviral |
| CYHSYRS | 984 | Antiproliferative, antiviral |
| CVHSYRA | 985 | Antiproliferative, antiviral |
| CVHSPRS | 986 | Antiproliferative, antiviral |
| CVHSPRA | 987 | Antiproliferative, antiviral |
| CVHTYRS | 988 | Antiproliferative, antiviral |
| CVHTYRA | 989 | Antiproliferative, antiviral |
| CVHTPRS | 990 | Antiproliferative, antiviral |
| CVHTPRA | 991 | Antiproliferative, antiviral |
| HWAWFK | 992 | anti-ischemic, growth hormone-liberating |

TABLE 21

MYOSTATIN INHIBITOR PEPTIDES

| PEPTIBODY NAME | SEQ ID | PEPTIDE SEQUENCE |
|---|---|---|
| Myostatin-TN8-Con1 | 1036 | KDKCKMWHWMCKPP |
| Myostatin-TN8-Con2 | 1037 | KDLCAMWHWMCKPP |
| Myostatin-TN8-Con3 | 1038 | KDLCKMWKWMCKPP |
| Myostatin-TN8-Con4 | 1039 | KDLCKMWHWMCKPK |
| Myostatin-TN8-Con5 | 1040 | WYPCYEFHFWCYDL |
| Myostatin-TN8-Con6 | 1041 | WYPCYEGHFWCYDL |

TABLE 21-continued

MYOSTATIN INHIBITOR PEPTIDES

| PEPTIBODY NAME | SEQ ID | PEPTIDE SEQUENCE |
|---|---|---|
| Myostatin-TN8-Con7 | 1042 | IFGCKWWDVQCYQF |
| Myostatin-TN8-Con8 | 1043 | IFGCKWWDVDCYQF |
| Myostatin-TN8-Con9 | 1044 | ADWCVSPNWFCMVM |
| Myostatin-TN8-Con10 | 1045 | HKFCPWWALFCWDF |
| Myostatin-TN8-1 | 1046 | KDLCKMWHWMCKPP |
| Myostatin-TN8-2 | 1047 | IDKCAIWGWMCPPL |
| Myostatin-TN8-3 | 1048 | WYPCGEFGMWCLNV |
| Myostatin-TN8-4 | 1049 | WFTCLWNCDNE |
| Myostatin-TN8-5 | 1050 | HTPCPWFAPLCVEW |
| Myostatin-TN8-6 | 1051 | KEWCWRWKWMCKPE |
| Myostatin-TN8-7 | 1052 | FETCPSWAYFCLDI |
| Myostatin-TN8-8 | 1053 | AYKCEANDWGCWWL |
| Myostatin-TN8-9 | 1054 | NSWCEDQWHRCWWL |
| Myostatin-TN8-10 | 1055 | WSACYAGHFWCYDL |
| Myostatin-TN8-11 | 1056 | ANWCVSPNWFCMVM |
| Myostatin-TN8-12 | 1057 | WTECYQQEFWCWNL |
| Myostatin-TN8-13 | 1058 | ENTCERWKWMCPPK |
| Myostatin-TN8-14 | 1059 | WLPCHQEGFWCMNF |
| Myostatin-TN8-15 | 1060 | STMCSQWHWMCNPF |
| Myostatin-TN8-16 | 1061 | IFGCHWWDVDCYQF |
| Myostatin-TN8-17 | 1062 | IYGCKWWDIQCYDI |
| Myostatin-TN8-18 | 1063 | PDWCIDPDWWCKFW |
| Myostatin-TN8-19 | 1064 | QGHCTRWPWMCPPY |
| Myostatin-TN8-20 | 1065 | WQECYREGFWCLQT |
| Myostatin-TN8-21 | 1066 | WFDCYGPGFKCWSP |
| Myostatin-TN8-22 | 1067 | GVRCPKGHLWCLYP |
| Myostatin-TN8-23 | 1068 | HWACGYWPWSCKWV |
| Myostatin-TN8-24 | 1069 | GPACHSPWWWCVFG |
| Myostatin-TN8-25 | 1070 | TTWCISPMWFCSQQ |
| Myostatin-TN8-26 | 1071 | HKFCPPWAIFCWDF |
| Myostatin-TN8-27 | 1072 | PDWCVSPRWYCNMW |
| Myostatin-TN8-28 | 1073 | VWKCHWFGMDCEPT |
| Myostatin-TN8-29 | 1074 | KKHCQIWTWMCAPK |
| Myostatin-TN8-30 | 1075 | WFQCGSTLFWCYNL |
| Myostatin-TN8-31 | 1076 | WSPCYDHYFYCYTI |
| Myostatin-TN8-32 | 1077 | SWMCGFFKEVCMWV |
| Myostatin-TN8-33 | 1078 | EMLCMIHPVFCNPH |
| Myostatin-TN8-34 | 1079 | LKTCNLWPWMCPPL |
| Myostatin-TN8-35 | 1080 | VVGCKWYEAWCYNK |

TABLE 21-continued

MYOSTATIN INHIBITOR PEPTIDES

| PEPTIBODY NAME | SEQ ID | PEPTIDE SEQUENCE |
|---|---|---|
| Myostatin-TN8-36 | 1081 | PIHCTQWAWMCPPT |
| Myostatin-TN8-37 | 1082 | DSNCPWYFLSCVIF |
| Myostatin-TN8-38 | 1083 | HIWCNLAMMKCVEM |
| Myostatin-TN8-39 | 1084 | NLQCIYFLGKCIYF |
| Myostatin-TN8-40 | 1085 | AWRCMWFSDVCTPG |
| Myostatin-TN8-41 | 1086 | WFRCFLDADWCTSV |
| Myostatin-TN8-42 | 1087 | EKICQMWSWMCAPP |
| Myostatin-TN8-43 | 1088 | WFYCHLNKSECTEP |
| Myostatin-TN8-44 | 1089 | FWRCAIGIDKCKRV |
| Myostatin-TN8-45 | 1090 | NLGCKWYEVWCFTY |
| Myostatin-TN8-46 | 1091 | IDLCNMWDGMCYPP |
| Myostatin-TN8-47 | 1092 | EMPCNIWGWMCPPV |
| Myostatin-TN12-1 | 1093 | WFRCVLTGIVDWSECFGL |
| Myostatin-TN12-2 | 1094 | GFSCTFGLDEFYVDCSPF |
| Myostatin-TN12-3 | 1095 | LPWCHDQVNADWGFCMLW |
| Myostatin-TN12-4 | 1096 | YPTCSEKFWIYGQTCVLW |
| Myostatin-TN12-5 | 1097 | LGPCPIHHGPWPQYCVYW |
| Myostatin-TN12-6 | 1098 | PFPCETHQISWLGHCLSF |
| Myostatin-TN12-7 | 1099 | HWGCEDLMWSWHPLCRRP |
| Myostatin-TN12-8 | 1100 | LPLCDADMMPTIGFCVAY |
| Myostatin-TN12-9 | 1101 | SHWCETTFWMNYAKCVHA |
| Myostatin-TN12-10 | 1102 | LPKCTHVPFDQGGFCLWY |
| Myostatin-TN12-11 | 1103 | FSSCWSPVSRQDMFCVFY |
| Myostatin-TN12-13 | 1104 | SHKCEYSGWLQPLCYRP |
| Myostatin-TN12-14 | 1105 | PWWCQDNYVQHMLHCDSP |
| Myostatin-TN12-15 | 1106 | WFRCMLMNSFDAFQCVSY |
| Myostatin-TN12-16 | 1107 | PDACRDQPWYMFMGCMLG |
| Myostatin-TN12-17 | 1108 | FLACFVEFELCFDS |
| Myostatin-TN12-18 | 1109 | SAYCIITESDPYVLCVPL |
| Myostatin-TN12-19 | 1110 | PSICESYSTMWLPMCQHN |
| Myostatin-TN12-20 | 1111 | WLDCHDDSWAWTKMCRSH |
| Myostatin-TN12-21 | 1112 | YLNCVMMNTSPFVECYFN |
| Myostatin-TN12-22 | 1113 | YPWCDGFMIQQGITCMFY |
| Myostatin-TN12-23 | 1114 | FDYCTWLNGFKDWKCWSR |
| Myostatin-TN12-24 | 1115 | LPLCNLKEISHVQACVLF |
| Myostatin-TN12-25 | 1116 | SPECAFARWLGIEQCQRD |

TABLE 21-continued

MYOSTATIN INHIBITOR PEPTIDES

| PEPTIBODY NAME | SEQ ID | PEPTIDE SEQUENCE |
|---|---|---|
| Myostatin-TN12-26 | 1117 | YPQCFNLHLLEWTECDWF |
| Myostatin-TN12-27 | 1118 | RWRCEIYDSEFLPKCWFF |
| Myostatin-TN12-28 | 1119 | LVGCDNVWHRCKLF |
| Myostatin-TN12-29 | 1120 | AGWCHVWGEMFGMGCSAL |
| Myostatin-TN12-30 | 1121 | HHECEWMARWMSLDCVGL |
| Myostatin-TN12-31 | 1122 | FPMCGIAGMKDFDFCVWY |
| Myostatin-TN12-32 | 1123 | RDDCTFWPEWLWKLCERP |
| Myostatin-TN12-33 | 1124 | YNFCSYLFGVSKEACQLP |
| Myostatin-TN12-34 | 1125 | AHWCEQGPWRYGNICMAY |
| Myostatin-TN12-35 | 1126 | NLVCGKISAWGDEACARA |
| Myostatin-TN12-36 | 1127 | HNVCTIMGPSMKWFCWND |
| Myostatin-TN12-37 | 1128 | NDLCAMWGWRNTIWCQNS |
| Myostatin-TN12-38 | 1129 | PPFCQNDNDMLLQSLCKLL |
| Myostatin-TN12-39 | 1130 | WYDCNVPNELLSGLCRLF |
| Myostatin-TN12-40 | 1131 | YGDCDQNHWMWPFTCLSL |
| Myostatin-TN12-41 | 1132 | GWMCHFDLHDWGATCQPD |
| Myostatin-TN12-42 | 1133 | YFHCMFGGHEFEVHCESF |
| Myostatin-TN12-43 | 1134 | AYWCWHGQCVRF |
| Myostatin-Linear-1 | 1135 | SEHWTFTDWDGNEWWVRPF |
| Myostatin-Linear-2 | 1136 | MEMLDSLFELLKDMVPISKA |
| Myostatin-Linear-3 | 1137 | SPPEEALMEWLGWQYGKFT |
| Myostatin-Linear-4 | 1138 | SPENLLNDLYILMTKQEWYG |
| Myostatin-Linear-5 | 1139 | FHWEEGIPFHVVTPYSYDRM |
| Myostatin-Linear-6 | 1140 | KRLLEQFMNDLAELVSGHS |
| Myostatin-Linear-7 | 1141 | DTRDALFQEFYEFVRSRLVI |
| Myostatin-Linear-8 | 1142 | RMSAAPRPLTYRDIMDQYWH |
| Myostatin-Linear-9 | 1143 | NDKAHFFEMFMFDVHNFVES |
| Myostatin-Linear-10 | 1144 | QTQAQKIDGLWELLQSIRNQ |
| Myostatin-Linear-11 | 1145 | MLSEFEEFLGNLVHRQEA |
| Myostatin-Linear-12 | 1146 | YTPKMGSEWTSFWHNRIHYL |
| Myostatin-Linear-13 | 1147 | LNDTLLRELKMVLNSLSDMK |
| Myostatin-Linear-14 | 1148 | FDVERDLMRWLEGFMQSAAT |
| Myostatin-Linear-15 | 1149 | HHGWNYLRKGSAPQWFEAWV |
| Myostatin-Linear-16 | 1150 | VESLHQLQMWLDQKLASGPH |
| Myostatin-Linear-17 | 1151 | RATLLKDFWQLVEGYGDN |
| Myostatin-Linear-18 | 1152 | EELLREFYRFVSAFDY |

TABLE 21-continued

MYOSTATIN INHIBITOR PEPTIDES

| PEPTIBODY NAME | SEQ ID | PEPTIDE SEQUENCE |
|---|---|---|
| Myostatin-Linear-19 | 1153 | GLLDEFSHFIAEQFYQMPGG |
| Myostatin-Linear-20 | 1154 | YREMSMLEGLLDVLERLQHY |
| Myostatin-Linear-21 | 1155 | HNSSQMLLSELIMLVGSMMQ |
| Myostatin-Linear-22 | 1156 | WREHFLNSDYIRDKLIAIDG |
| Myostatin-Linear-23 | 1157 | QFPFYVFDDLPAQLEYWIA |
| Myostatin-Linear-24 | 1158 | EFFHWLHNHRSEVNHWLDMN |
| Myostatin-Linear-25 | 1159 | EALFQNFFRDVLTLSEREY |
| Myostatin-Linear-26 | 1160 | QYWEQQWMTYFRENGLHVQY |
| Myostatin-Linear-27 | 1161 | NQRMMLEDLWRIMTPMFGRS |
| Myostatin-Linear-29 | 1162 | FLDELKAELSRHYALDDLDE |
| Myostatin-Linear-30 | 1163 | GKLIEGLLNELMQLETFMPD |
| Myostatin-Linear-31 | 1164 | ILLLDEYKKDWKSWF |
| Myostatin-2xTN8-19 kc | 1165 | QGHCTRWPWMCPPYGSGSATGGSGSTASSGSGSATG QGHCTRWPWMCPPY |
| Myostatin-2xTN8-con6 | 1166 | WYPCYEGHFWCYDLGSGSTASSGSGSATGWYPCYEG HFWCYDL |
| Myostatin-2xTN8-5 kc | 1167 | HTPCPWFAPLCVEWGSGSATGGSQSTASSGSGSATGH TPCPWFAPLCVEW |
| Myostatin-2xTN8-18 kc | 1168 | PDWCIDPDWWCKFWGSGSATGGSGSTASSGSGSATG PDWCIDPDWWCKFW |
| Myostatin-2xTN8-11 kc | 1169 | ANWCVSPNWFCMVMGSGSATGGSGSTASSGSGSAT GANWCVSPNWFCMVM |
| Myostatin-2xTN8-25 kc | 1170 | PDWCIDPDWWCKFWGSGSATGGSGSTASSGSGSATG PDWCIDPDWWCKFW |
| Myostatin-2xTN8-23 kc | 1171 | HWACGYWPWSCKWVGSGSATGGSGSTASSGSGSAT GHWACGYWPWSCKWV |
| Myostatin-TN8-29-19 kc | 1172 | KKHCQIWTWMCAPKGSGSATGGSGSTASSGSGSATG QGHCTRWPWMCPPY |
| Myostatin-TN8-19-29 kc | 1173 | QGHCTRWPWMCPPYGSGSATGGSGSTASSGSGSATG KKHCQIWTWMCAPK |
| Myostatin-TN8-29-19 kn | 1174 | KKHCQIWTWMCAPKGSGSATGGSGSTASSGSGSATG QGHCTRWPWMCPPY |
| Myostatin-TN8-29-19-8g | 1175 | KKHCQIWTWMCAPKGGGGGGGGQGHCTRWPWMCP PY |
| Myostatin-TN8-19-29-6gc | 1176 | QGHCTRWPWMCPPYGGGGGGKKHCQIWTWMCAPK |

TABLE 22

MYOSTATIN INHIBITOR PEPTIDES

| Affinity-matured peptibody | SEQ ID NO: | Peptide sequence |
|---|---|---|
| mTN8-19-1 | 1177 | VALHGQCTRWPWMCPPQREG |
| mTN8-19-2 | 1178 | YPEQGLCTRWPWMCPPQTLA |
| mTN8-19-3 | 1179 | GLNQGHCTRWPWMCPPQDSN |
| mTN8-19-4 | 1180 | MITQGQCTRWPWMCPPQPSG |
| mTN8-19-5 | 1181 | AGAQEHCTRWPWMCAPNDWI |
| mTN8-19-6 | 1182 | GVNQGQCTRWRWMCPPNGWE |
| mTN8-19-7 | 1183 | LADHGQCIRWPWMCPPEGWE |
| mTN8-19-8 | 1184 | ILEQAQCTRWPWMCPPQRGG |
| mTN8-19-9 | 1185 | TQTHAQCTRWPWMCPPQWEG |
| mTN8-19-10 | 1186 | VVTQGHCTLWPWMCPPQRWR |
| mTN8-19-11 | 1187 | IYPHDQCTRWPWMCPPQPYP |
| mTN8-19-12 | 1188 | SYWQGQCTRWPWMCPPQWRG |
| mTN8-19-13 | 1189 | MWQQGHCTRWPWMCPPQGWG |
| mTN8-19-14 | 1190 | EFTQWHCTRWPWMCPPQRSQ |
| mTN8-19-15 | 1191 | LDDQWQCTRWPWMCPPQGFS |
| mTN8-19-16 | 1192 | YQTQGLCTRWPWMCPPQSQR |
| mTN8-19-17 | 1193 | ESNQGQCTRWPWMCPPQGGW |

TABLE 22-continued

MYOSTATIN INHIBITOR PEPTIDES

| Affinity-matured peptibody | SEQ ID NO: | Peptide sequence |
|---|---|---|
| mTN8-19-18 | 1194 | WTDRGPCTRWPWMCPPQANG |
| mTN8-19-19 | 1195 | VGTQGQCTRWPWMCPPYETG |
| mTN8-19-20 | 1196 | PYEQGKCTRWPWMCPPYEVE |
| mTN8-19-21 | 1197 | SEYQGLCTRWPWMCPPQGWK |
| mTN8-19-22 | 1198 | TFSQGHCTRWPWMCPPQGWG |
| mTN8-19-23 | 1199 | PGAHDHCTRWPWMCPPQSRY |
| mTN8-19-24 | 1200 | VAEEWHCRRWPWMCPPQDWR |
| mTN8-19-25 | 1201 | VGTQGHCTRWPWMCPPQPAG |
| mTN8-19-26 | 1202 | EEDQARCRSWPWMCPPQGWV |
| mTN8-19-27 | 1203 | ADTQGHCTRWPWMCPPQHWF |
| mTN8-19-28 | 1204 | SGPQGHCTRWPWMCAPQGWF |
| mTN8-19-29 | 1205 | TLVQGHCTRWPWMCPPQRWV |
| mTN8-19-30 | 1206 | GMAHGKCTRWAWMCPPQSWK |
| mTN8-19-31 | 1207 | ELYHGQCTRWPWMCPPQSWA |
| mTN8-19-32 | 1208 | VADHGHCTRWPWMCPPQGWG |
| mTN8-19-33 | 1209 | PESQGHCTRWPWMCPPQGWG |
| mTN8-19-34 | 1210 | IPAHGHCTRWPWMCPPQRWR |
| mTN8-19-35 | 1211 | FTVHGHCTRWPWMCPPYGWV |
| mTN8-19-36 | 1212 | PDFPGHCTRWRWMCPPQGWE |
| mTN8-19-37 | 1213 | QLWQGPCTQWPWMCPPKGRY |
| mTN8-19-38 | 1214 | HANDGHCTRWQWMCPPQWGG |
| mTN8-19-39 | 1215 | ETDHGLCTRWPWMCPPYGAR |
| mTN8-19-40 | 1216 | GTWQGLCTRWPWMCPPQGWQ |
| mTN8-19 con1 | 1217 | VATQGQCTRWPWMCPPQGWG |
| mTN8-19 con2 | 1218 | VATQGQCTRWPWMCPPQRWG |
| mTN8 con6-1 | 1219 | QREWYPCYGGHLWCYDLHKA |
| mTN8 con6-2 | 1220 | ISAWYSCYAGHFWCWDLKQK |
| mTN8 con6-3 | 1221 | WTGWYQCYGGHLWCYDLRRK |
| mTN8 con6-4 | 1222 | KTFWYPCYDGHFWCYNLKSS |
| mTN8 con6-5 | 1223 | ESRWYPCYEGHLWCFDLTET |

TABLE 23

MYOSTATIN INHIBITOR PEPTIDES

| Affinity matured peptibody | SEQ ID NO: | Peptide Sequence |
|---|---|---|
| L2 | 1224 | MEMLDSLFELLKDMVPISKA |
| mL2-Con1 | 1225 | RMEMLESLLELLKEIVPMSKAG |
| mL2-Con2 | 1226 | RMEMLESLLELLKEIVPMSKAR |
| mL2-1 | 1227 | RMEMLESLLELLKDIVPMSKPS |
| mL2-2 | 1228 | GMEMLESLFELLQEIVPMSKAP |
| mL2-3 | 1229 | RMEMLESLLELLKDIVPISNPP |
| mL2-4 | 1230 | RIEMLESLLELLQEIVPISKAE |
| mL2-5 | 1231 | RMEMLQSLLELLKDIVPMSNAR |
| mL2-6 | 1232 | RMEMLESLLELLKEIVPTSNGT |
| mL2-7 | 1233 | RMEMLESLFELLKEIVPMSKAG |
| mL2-8 | 1234 | RMEMLGSLLELLKEIVPMSKAR |
| mL2-9 | 1235 | QMELLDSLFELLKEIVPKSQPA |
| mL2-10 | 1236 | RMEMLDSLLELLKEIVPMSNAR |
| mL2-11 | 1237 | RMEMLESLLELLHEIVPMSQAG |
| mL2-12 | 1238 | QMEMLESLLQLLKEIVPMSKAS |
| mL2-13 | 1239 | RMEMLDSLLELLKDMVPMTTGA |
| mL2-14 | 1240 | RIEMLESLLELLKDMVPMANAS |
| mL2-15 | 1241 | RMEMLSLLQLLNEIVPMSRAR |
| mL2-16 | 1242 | RMEMLESLFDLLKELVPMSKGV |
| mL2-17 | 1243 | RIEMLESLLELLKDLVPIQKAR |
| mL2-18 | 1244 | RMELLESLFELLKDMVPMSDSS |
| mL2-19 | 1245 | RMEMLESLLEVLQEIVPRAKGA |
| mL2-20 | 1246 | RMEMLDSLLQLLNEIVPMSHAR |
| mL2-21 | 1247 | RMEMLESLLELLKDIVPMSNAG |
| mL2-22 | 1248 | RMEMLQSLFELLKGMVPISKAG |
| mL2-23 | 1249 | RMEMLESLLELLKEIVPNSTAA |
| mL2-24 | 1250 | RMEMLQSLLELLKEIVPISKAG |
| mL2-25 | 1251 | RIEMLDSLLELLNELVPMSKAR |
| L-15 | 1252 | HHGWNYLRKGSAPQWFEAWV |
| mL15-con1 | 1253 | QVESLQQLLMWLDQKLASGPQG |
| mL15-1 | 1254 | RMELLESLFELLKEMVPRSKAV |
| mL15-2 | 1255 | QAVSLQHLLMWLDQKLASGPQH |
| mL15-3 | 1256 | DEDSLQQLLMWLDQKLASGPQL |
| mL15-4 | 1257 | PVASLQQLLIWLDQKLAQGPHA |
| mL15-5 | 1258 | EVDELQQLLNWLDHKLASGPLQ |
| mL15-6 | 1259 | DVESLEQLLMWLDHQLASGPHG |
| mL15-7 | 1260 | QVDSLQQVLLWLEHKLALGPQV |
| mL15-8 | 1261 | GDESLQHLLMWLEQKLALGPHG |
| mL15-9 | 1262 | QIEMLESLLDLLRDMVPMSNAF |

TABLE 23-continued

MYOSTATIN INHIBITOR PEPTIDES

| Affinity matured peptibody | SEQ ID NO: | Peptide Sequence |
|---|---|---|
| mL15-10 | 1263 | EVDSLQQLLMWLDQKLASGPQA |
| mL15-11 | 1264 | EDESLQQLLIYLDKMLSSGPQV |
| mL15-12 | 1265 | AMDQLHQLLIWLDHKLASGPQA |
| mL15-13 | 1266 | RIEMLESLLELLDEIALIPKAW |
| mL15-14 | 1267 | EVVSLQHLLMWLEHKLASGPDG |
| mL15-15 | 1268 | GGESLQQLLMWLDQQLASGPQR |
| mL15-16 | 1269 | GVESLQQLLIFLDHMLVSGPHD |
| mL15-17 | 1270 | NVESLEHLMMWLERLLASGPYA |
| mL15-18 | 1271 | QVDSLQQLLIWLDHQLASGPKR |
| mL15-19 | 1272 | EVESLQQLLMWLEHKLAQGPQG |
| mL15-20 | 1273 | EVDSLQQLLMWLDQKLASGPHA |
| mL15-21 | 1274 | EVDSLQQLLMWLDQQLASGPQK |
| mL15-22 | 1275 | GVEQLPQLLMWLEQKLASGPQR |
| mL15-23 | 1276 | GEDSLQQLLMWLDQQLAAGPQV |
| mL15-24 | 1277 | ADDSLQQLLMWLDRKLASGPHV |
| mL15-25 | 1278 | PVDSLQQLLIWLDQKLASGPQG |
| L-17 | 1279 | RATLLKDFWQLVEGYGDN |
| mL17-con1 | 1280 | DWRATLLKEFWQLVEGLGDNLV |
| mL17-con2 | 1281 | QSRATLLKEFWQLVEGLGDKQA |
| mL17-1 | 1282 | DGRATLLTEFWQLVQGLGQKEA |
| mL17-2 | 1283 | LARATLLKEFWQLVEGLGEKVV |
| mL17-3 | 1284 | GSRDTLLKEFWQLVVGLGDMQT |
| mL17-4 | 1285 | DARATLLKEFWQLVDAYGDRMV |
| mL17-5 | 1286 | NDRAQLLRDFWQLVDGLGVKSW |
| mL17-6 | 1287 | GVRETLLYELWYLLKGLGANQG |
| mL17-7 | 1288 | QARATLLKEFCQLVGCQGDKLS |
| mL17-8 | 1289 | QERATLLKEFWQLVAGLGQNMR |
| mL17-9 | 1290 | SGRATLLKEFWQLVQGLGEYRW |
| mL17-10 | 1291 | TMRATLLKEFWLFVDGQREMQW |
| mL17-11 | 1292 | GERATLLNDFWQLVDGQGDNTG |
| mL17-12 | 1293 | DERETLLKEFWQLVHGWGDNVA |
| mL17-13 | 1294 | GGRATLLKELWQLLEGQGANLV |
| mL17-14 | 1295 | TARATLLNELVQLVKGYGDKLV |
| mL17-15 | 1295 | GMRATLLQEFWQLVGGQGDNWM |
| mL17-16 | 1297 | STRATLLNDLWQLMKGWAEDRG |
| mL17-17 | 1298 | SERATLLKELWQLVGGWGDNFG |
| mL17-18 | 1299 | VGRATLLKEFWQLVEGLVGQSR |

TABLE 23-continued

MYOSTATIN INHIBITOR PEPTIDES

| Affinity matured peptibody | SEQ ID NO: | Peptide Sequence |
|---|---|---|
| mL17-19 | 1300 | EIRATLLKEFWQLVDEWREQPN |
| mL17-20 | 1301 | QLRATLLKEFLQLVHGLGETDS |
| mL17-21 | 1302 | TQRATLLKEFWQLIEGLGGKHV |
| mL17-22 | 1303 | HYRATLLKEFWQLVDGLREQGV |
| mL17-23 | 1304 | QSRVTLLREFWQLVESYRPIVN |
| mL17-24 | 1305 | LSRATLLNEFWQFVDGQRDKRM |
| mL17-25 | 1306 | WDRATLLNDFWHLMEELSQKPG |
| mL17-26 | 1307 | QERATLLKEFWRMVEGLGKNRG |
| mL17-27 | 1308 | NERATLLREFWQLVGGYGVNQR |
| L-20 | 1309 | YREMSMLEGLLDVLERLQHY |
| mL20-1 | 1310 | HQRDMSMLWELLDVLDGLRQYS |
| mL20-2 | 1311 | TQRDMSMLDGLLEVLDQLRQQR |
| mL20-3 | 1312 | TSRDMSLLWELLEELDRLGHQR |
| mL20-4 | 1313 | MQHDMSMLYGLVELLESLGHQI |
| mL20-5 | 1314 | WNRDMRMLESLFEVLDGLRQQV |
| mL20-6 | 1315 | GYRDMSMLEGLLAVLDRLGPQL |
| mL20 con1 | 1316 | TQRDMSMLEGLLEVLDRLGQQR |
| mL20 con2 | 1317 | WYRDMSMLEGLLEVLDRLGQQR |
| L-21 | 1318 | HNSSQMLLSELIMLVGSMMQ |
| mL21-1 | 1319 | TQNSRQMLLSDFMMLVGSMIQG |
| mL21-2 | 1320 | MQTSRHILLSEFMMLVGSIMHG |
| mL21-3 | 1321 | HDNSRQMLLSDLLBLVGTMIQG |
| mL21-4 | 1322 | MENSRQNLLRELIMLVGNMSHQ |
| mL21-5 | 1323 | QDTSRHMLLREFMMLVGEMIQG |
| mL21 con1 | 1324 | DQNSRQMLLSDLMILVGSMIQG |
| L-24 | 1325 | EFFHWLHNHRSEVNHWLDMN |
| mL24-1 | 1326 | NVFFQWVQKHGRVVYQWLDINV |
| mL24-2 | 1327 | FDFLQWLQNHRSEVEHWLVMDV |

TABLE 24

MYOSTATIN INHIBITOR PEPTIDES

| Peptibody Name | Peptide |
|---|---|
| 2x mTN8-Con6-(N)-1K | M-GAQ-WYPCYEGHFWCYDL-GSGSATGGSGSTASSGSGSATG-WYPCYEGHFWCYDL-LE-5G-FC (SEQ ID NO: 1328) |
| 2x mTN8-Con6-(C)-1K | FC-5G-AQ-WYPCYEGHFWCYDL-GSGSATGGSGSTASSGSGSATG-WYPCYEGHFWCYDL-LE (SEQ ID NO: 1329) |

TABLE 24-continued

MYOSTATIN INHIBITOR PEPTIDES

| Peptibody Name | Peptide |
|---|---|
| 2x mTN8-Con7-(N)-1K | M-GAQ-IFGCKWWDVQCYQF-GSGSATGGSGSTASSGSGSATG-IFGCKWWDVQCYQF-LE-5G-FC (SEQ ID NO: 1330) |
| 2x mTN8-Con7-(C)-1K | FC-5G-AQ-IFGCKWWDVQCYQF-GSGSATGGSGSTASSGSGSATG-IFGCKWWDVQCYQF-LE (SEQ ID NO: 1331) |
| 2x mTN8-Con8-(N)-1K | M-GAQ-IFGCKWWDVDCYQF-GSGSATGGSGSTASSGSGSATG-IFGCKWWDVDCYQF-LE-5G-FC (SEQ ID NO: 1332) |
| 2x mTN8-Con8-(C)-1K | FC-5G-AQ-IFGCKWWDVDCYQF-GSGSATGGSGSTASSGSGSATG-IFGCKWWDVDCYQF-LE (SEQ ID NO: 1333) |
| 2X mTN8-19-7 | FC-5G-AQ-LADHGQCIRWPWMCPPEGWELEGSGSATGGSGSTASSGSGSATGLADHGQCIRWPWMCPPEGWE-LE (SEQ ID NO: 1334) |
| 2X mTN8-19-7 ST-GG de12x LE | FC-5G-AQ-LADHGQCIRWPWMCPPEGWEGSGSATGGSGGGASSGSGSATGLADHGQCIRWPWMCPPEGWE (SEQ ID NO: 1335) |
| 2X mTN8-219-1 | FC-5G-AQ-SEYQGLCTRWPWMCPPQGWKLEGSGSATGGSGSTASSGSGSATGSEYQGLCTRWPWMCPPQGWK-LE (SEQ ID NO: 1336) |
| 2X mTN8-19-21 ST-GG de12x LE | FC-5G-AQ-SEYQGLCTRWPWMCPPQGWKGSGSATGGSGGGASSGSGSATGSEYQGLCTRWPWMCPPQGWK (SEQ ID NO: 1337) |
| 2X mTN8-19-22 | FC-5G-AQ-TFSQGHCTRWPWMCPPQGWGLEGSGSATGGSGSTASSGSGSATGTFSQGHCTRWPWMCPPQGWG-LE (SEQ ID NO: 1338) |
| 2X mTN8-19-32 | FC-5G-AQ-VADHGHCTRWPWMCPPQGWGLEGSGSATGGSGSTASSGSGSATGVADHGHCTRWPWMGPPQGWG-LE (SEQ ID NO: 1339) |
| 2X mTN8-19-32 ST-GG de12x LE | FC-5G-AQ-VADHGHCTRWPWMCPPQGWGGSGSATGGSGGGASSGSGSATGVADHGHCTRWPWVCPPQGWG (SEQ ID NO: 1340) |
| 2X mTN8-19-33 | FC-5G-AQ-PESQGHCTRWPWMCPPQGWGLEGSGSATGGSGSTASSGSGSATGPESQGHCTRWPWMCPPQGWGLE (SEQ ID NO: 1341) |
| 2X mTN8-19-33 ST-GG de12x LE | FC-5G-AQ-PESQGHCTRWPWMCPPQGWGGSGSATGGSGGGASSGSGSATGPESQGHCTRWPWMCP PQGWG LE (SEQ ID NO: 1342) |

TABLE 25

Integrin-antagonist peptide sequences

| Sequence/structure | SEQ. ID NO: |
|---|---|
| CLCRGDCIC | 1344 |
| CWDDGWLC | 1345 |
| CWDDLWWLC | 1346 |
| CWDDGLMC | 1347 |
| CWDDGWMC | 1348 |
| CSWDDGWLC | 1349 |
| CPDDLWWLC | 1350 |
| NGR | 1351 |
| GSL | 1352 |
| RGD | 1353 |
| CGRECPRLCQSSC | 1354 |
| CNGRCVSGCAGRC | 1355 |
| CLSGSLSC | 1356 |
| GSL | 1357 |
| NGRAHA | 1358 |
| CNGRC | 1359 |
| CDCRGDCFC | 1360 |
| CGSLVRC | 1361 |
| DLXXL | 1362 |
| RTDLDSLRTYTL | 1363 |
| RTDLDSLRTY | 1364 |
| RTDLDSLRT | 1365 |
| RTDLDSLR | 1366 |
| GDLDLLKLRLTL | 1367 |
| GDLHSLRQLLSR | 1368 |
| RDDLHMLRLQLW | 1369 |
| SSDLHALKKRYG | 1370 |
| RGDLKQLSELTW | 1371 |
| CXXRGDC | 1372 |
| STGGFDDVYDWARGVSSALTTTLVATR | 1373 |
| STGGFDDVYDWARRVSSALTTTLVATR | 1374 |
| SRGVNFSEWLYDMSAAMKEASNVFPSRRSR | 1375 |
| SSQNWDMEAGVEDLTAAMLGLLSTIHSSSR | 1376 |
| SSPSLYTQFLVNYESAATRIQDLLIASRPSR | 1377 |
| SSTGWVDLLGALQRAADATRTSIPPSLQNSR | 1378 |
| DVYTKKELIECARRVSEK | 1379 |
| RGDGX | 1380 |
| CRGDGXC | 1381 |
| CARRLDAPC | 1382 |

TABLE 25-continued

Integrin-antagonist peptide sequences

| Sequence/structure | SEQ. ID NO: |
|---|---|
| CPSRLDSPC | 1383 |
| CDCRGDCFC | 1384 |
| CDCRGDCLC | 1385 |
| RGDLAALSAPPV | 1386 |

TABLE 26

Selectin antagonist peptide sequences

| Sequence/structure | SEQ ID NO: |
|---|---|
| DITWDQLWDLMK | 1387 |
| DITWDELWKIMN | 1388 |
| DYTWFELWDMMQ | 1389 |
| QITWAQLWNMMK | 1390 |
| DMTWHDLWTLMS | 1391 |
| DYSWHDLWEMMS | 1392 |
| EITWDQLWEVMN | 1393 |
| HVSWEQLWDIMN | 1394 |
| HITWDQLWRIMT | 1395 |
| RNMSWLELWEHMK | 1396 |
| AEWTWDQLWHVMNPAESQ | 1397 |
| HRAEWLALWEQMSP | 1398 |
| KKEDWLALWRIMSV | 1399 |
| ITWDQLWDLMK | 1400 |
| DITWDQLWDLMK | 1401 |
| DITWDQLWDLMK | 1402 |
| DITWDQLWDLMK | 1403 |
| CQNRYTDLVAIQNKNE | 1404 |
| AENWADNEPNNKRNNED | 1405 |
| RKNNKTWTWVGTKKALTNE | 1406 |
| KKALTNEAENWAD | 1407 |
| CQXRYTDLVAIQNKXE | 1408 |
| AENWADGEPNNKXNXED | 1409 |

TABLE 27

Vinculin binding peptides

| Sequence/structure | SEQ ID NO: |
|---|---|
| SSQNWDMEAGVEDLTAAMLGLLSTIHSSSR | 1410 |
| SSPSLYTQFLVNYESAATRIQDLLIASRPSR | 1411 |

TABLE 27-continued

Vinculin binding peptides

| Sequence/structure | SEQ ID NO: |
|---|---|
| SSTGWVDLLGALQRAADATRTSIPPSLQNSR | 1412 |
| DVYTKKELIECARRVSEK | 1413 |
| STGGFDDVYDWARGVSSALTTTLVATR | 1414 |
| STGGFDDVYDWARRVSSALTTTLVATR | 1415 |
| SRGVNFSEWLYDMSAAMKEASNVFPSRRSR | 1416 |

TABLE 28

Laminin-related peptide sequences

| Sequence/structure | SEQ ID NO: |
|---|---|
| YIGSRYIGSR [i.e., (YIGSR)$_2$] | 1417 |
| YIGSRYIGSRYIGSR [i.e., (YIGSR)$_3$] | 1418 |
| YIGSRYIGSRYIGSRYIGSR [i.e., (YIGSR)$_4$] | 1419 |
| YIGSRYIGSRYIGSRYIGSRYIGSR [i.e., (YIGSR)$_5$] | 1420 |
| IPCNNKGAHSVGLMWWMLAR | 1421 |
| YIGSRREDVEILDVPDSGR | 1422 |
| RGDRGDYIGSRRGD | 1423 |
| YIGSRYIGSRYIGSRYIGSR | 1424 |
| REDVEILDVYIGSRPDSGR | 1425 |
| YIGSRREDVEILDVPDSGR | 1426 |

TABLE 29

NGF Modulating Peptides

| SEQ ID NO: | Sequence of Peptide Portion of Fc-Peptide Fusion Product |
|---|---|
| 1427 | TGYTEYTEEWPMGFGYQWSF |
| 1428 | TDWLSDFPFYEQYFGLMPPG |
| 1429 | FMRFPNPWKLVEPPQGWYYG |
| 1430 | VVKAPHFEFLAPPHFHEFPF |
| 1431 | FSYIWIDETPSNIDRYMLWL |
| 1432 | VNFPKVPEDVEPWPWSLKLY |
| 1433 | TWHPKTYEEFALPFFVPEAP |
| 1434 | WHFGTPYIQQQPGVYWLQAP |
| 1435 | VWNYGPFFMNFPDSTYFLHE |
| 1436 | WRIHSKPLDYSHVWFFPADF |
| 1437 | FWDGNQPPDILVDWPWNPPV |
| 1438 | FYSLEWLKDHSEFFQTVTEW |
| 1439 | QFMELLKFFNSPGDSSHHFL |

TABLE 29-continued

NGF Modulating Peptides

| SEQ ID NO: | Sequence of Peptide Portion of Fc-Peptide Fusion Product |
|---|---|
| 1440 | TNYDWISNNWEHMKSFFTED |
| 1441 | PNEKPYQMQSWFPPDWPVPY |
| 1442 | WSHTEWVPQVWWKPPNHFYV |
| 1443 | WGEWLNDAQVHMHEGFISES |
| 1444 | VPWEHDHDLWEIISQDWHIA |
| 1445 | VLHLQDPRGWSNFPPGVLEL |
| 1446 | IHGCWFTEEGCVWQ |
| 1447 | YMQCQFARDGCPQW |
| 1448 | KLQCQYSESGCPTI |
| 1449 | FLQCEISGGACPAP |
| 1450 | KLQCEFSTSGCPDL |
| 1451 | KLQCEFSTQGCPDL |
| 1452 | KLQCEFSTSGCPWL |
| 1453 | IQGCWFTEEGCPWQ |
| 1454 | SFDCDNPWGHVLQSCFGF |
| 1455 | SFDCDNPWGHKLQSCFGF |

TABLE 30

TALL MODULATING PEPTIDES

| Sequence/structure | SEQ ID NO: |
|---|---|
| LPGCKWDLLIKQWVCDPL- Λ -V¹ | 1456 |
| V¹- Λ - LPGCKWDLLIKQWVCDPL | 1457 |
| LPGCKWDLLIKQWVCDPL - Λ - LPGCKWDLLIKQWVCDPL - Λ -V¹ | 1458 |
| V¹- Λ - LPGCKWDLLIKQWVCDPL - Λ - LPGCKWDLLIKQWVCDPL | 1459 |
| SADCYFDILTKSDVCTSS- Λ -V¹ | 1460 |
| V¹- Λ - SADCYFDILTKSDVCTSS | 1461 |
| SADCYFDILTKSDVTSS- Λ - SADCYFDILTKSDVTSS- Λ -V¹ | 1462 |
| V¹- Λ - SADCYFDILTKSDVTSS - Λ - SADCYFDILTKSDVTSS | 1463 |
| FHDCKWDLLTKQWVCHGL- Λ -V¹ | 1464 |
| V¹- Λ - FHDCKWDLLTKQWVCHGL | 1465 |
| FHDCKWDLLTKQWVCHGL - Λ - FHDCKWDLLTKQWVCHGL | 1466 |
| V¹- Λ - FHDCKWDLLTKQWVCHGL - Λ - FHDCKWDLLTKQWVCHGL | 1467 |

TABLE 31

TALL-1 inhibitory peptibodies.

| Peptibody | SEQ ID NO | Peptide Sequence |
|---|---|---|
| TALL-1-8-1-a | 1468 | MPGTCFPFPW ECTHAGGGGG VDKTHTCPPC PAPELLGGPS VFLFPPKPKD TLMISRTPEV TCVVVDVSHE DPEVKFNWYV DGVEVHNAKT KPREEQYNST YRVVSVLTVL HQDWLNGKEY KCKVSNKALP APIEKTISKA KGQPREPQVY TLPPSRDELT KNQVSLTCLV KGFYPSDIAV EWESNGQPEN NYKTTPPVLD SDGSFFLYSK LTVDKSRWQQ GNVFSCSVMH EALHNHYTQK SLSLSPGK |
| TALL-1-8-2-a | 1469 | MWGACWPFPW ECFKEGGGGG VDKTHTCPPC PAPELLGGPS VFLFPPKPKD TLMISRTPEV TCVVVDVSHE DPEVKFNWYV DGVEVHNAKT KPREEQYNST YRVVSVLTVL HQDWLNGKEY KCKVSNKALP APIEKTISKA KGQPREPQVY TLPPSRDELT KNQVSLTCLV KGFYPSDIAV EWESNGQPEN NYKTTPPVLD SDGSFFLYSK LTVDKSRWQQ GNVFSCSVMH EALHNHYTQK SLSLSPGK |
| TALL-1-8-4-a | 1470 | MVPFCDLLTK HCFEAGGGGG VDKTHTCPPC PAPELLGGPS VFLFPPKPKD TLMISRTPEV TCVVVDVSHE DPEVKFNWYV DGVEVHNAKT KPREEQYNST YRVVSVLTVL HQDWLNGKEY KCKVSNKALP APIEKTISKA KGQPREPQVY TLPPSRDELT KNQVSLTCLV KGFYPSDIAV EWESNGQPEN NYKTTPPVLD SDGSFFLYSK LTVDKSRWQQ GNVFSCSVMH EALHNHYTQK SLSLSPGK |
| TALL-1-12-4-a | 1471 | MGSRCKYKWD VLTKQCFHHG GGGGVDKTHT CPPCPAPELL GGPSVFLFPP KPKDTLMISR TPEVTCVVVD VSHEDPEVKF NWYVDGVEVH NAKTKPREEQ YNSTYRVVSV LTVLHQDWLN GKEYKCKVSN KALPAPIEKT ISKAKGQPRE PQVYTLPPSR DELTKNQVSL TCLVKGFYPS DIAVEWESNG QPENNYKTTP PVLDSDGSFF LYSKLTVDKS RWQQGNVFSC SVMHEALHNH YTQKSLSLSP GK |
| TALL-1-12-3-a | 1472 | MLPGCKWDLL IKQWVCDPLG GGGGVDKTHT CPPCPAPELL GGPSVFLFPP KPKDTLMISR TPEVTCVVVD VSHEDPEVKF NWYVDGVEVH NAKTKPREEQ YNSTYRVVSV LTVLHQDWLN GKEYKCKVSN KALPAPIEKT ISKAKGQPRE PQVYTLPPSR DELTKNQVSL TCLVKGFYPS DIAVEWESNG QPENNYKTTP PVLDSDGSFF LYSKLTVDKS RWQQGNVFSC SVMHEALHNH YTQKSLSLSP GK |
| TALL-1-12-5-a | 1473 | MSADCYFDIL TKSDVCTSSG GGGGVDKTHT CPPCPAPELL GGPSVFLFPP KPKDTLMISR TPEVTCVVVD VSHEDPEVKF NWYVDGVEVH NAKTKPREEQ YNSTYRVVSV LTVLHQDWLN GKEYKCKVSN KALPAPIEKT ISKAKGQPRE PQVYTLPPSR DELTKNQVSL TCLVKGFYPS DIAVEWESNG QPENNYKTTP PVLDSDGSFF LYSKLTVDKS RWQQGNVFSC SVMHEALHNH YTQKSLSLSP GK |
| TALL-1-12-8-a | 1474 | MSDDCMYDQL TRMFICSNLG GGGGVDKTHT CPPCPAPELL GGPSVFLFPP KPKDTLMISR TPEVTCVVVD VSHEDPEVKF NWYVDGVEVH NAKTKPREEQ YNSTYRVVSV LTVLHQDWLN GKEYKCKVSN KALPAPIEKT ISKAKGQPRE PQVYTLPPSR DELTKNQVSL TCLVKGFYPS DIAVEWESNG QPENNYKTTP PVLDSDGSFF LYSKLTVDKS RWQQGNVFSC SVMHEALHNH YTQKSLSLSP GK |

TABLE 31-continued

TALL-1 inhibitory peptibodies.

| Peptibody | Peptibody SEQ ID NO | Peptide Sequence |
|---|---|---|
| TALL-1-12-9-a | 1475 | MDLNCKYDEL TYKEWCQFNG GGGGVDKTHT CPPCPAPELL GGPSVFLFPP KPKDTLMISR TPEVTCVVVD VSHEDPEVKF NWYVDGVEVH NAKTKPREEQ YNSTYRVVSV LTVLHQDWLN GKEYKCKVSN KALPAPIEKT ISKAKGQPRE PQVYTLPPSR DELTKNQVSL TCLVKGFYPS DLAVEWESNG QPENNYKTTP PVLDSDGSFF LYSKLTVDKS RWQQGNVFSC SVMHEALHNH YTQKSLSLSP GK |
| TALL-1-12-10-a | 1476 | MFHDCKYDLL TRQMVCHGLG GGGGVDKTHT CPPCPAPELL GGPSVFLFPP KPKDTLMISR TPEVTCVVVD VSHEDPEVKF NWYVDGVEVH NAKTKPREEQ YNSTYRVVSV LTVLHQDWLN GKEYKCKVSN KALPAPIEKT ISKAKGQPRE PQVYTLPPSR DELTKNQVSL TCLVKGFYPS DIAVEWESNG QPENNYKTTP PVLDSDGSFF LYSKLTVDKS RWQQGNVFSC SVMHEALHNH YTQKSLSLSP GK |
| TALL-1-12-11-a | 1477 | MRNHCFWDHL LKQDICPSPG GGGGVDKTHT CPPCPAPELL GGPSVFLFPP KPKDTLMISR TPEVTCVVVD VSHEDPEVKF NWYVDGVEVH NAKTKPREEQ YNSTYRVVSV LTVLHQDWLN GKEYKCKVSN KALPAPIEKT ISKAKGQPRE PQVYTLPPSR DELTKNQVSL TCLVKGFYPS DIAVEWESNG QPENNYKTTP PVLDSDGSFF LYSKLTVDKS RWQQGNVFSC SVMHEALHNH YTQKSLSLSP GK |
| TALL-1-12-14-a | 1478 | MANQCWWDSL TKKNVCEFFG GGGGVDKTHT CPPCPAPELL GGPSVFLFPP KPKDTLMISR TPEVTCVVVD VSHEDPEVKF NWYVDGVEVH NAKTKPREEQ YNSTYRVVSV LTVLHQDWLN GKEYKCKVSN KALPAPIEKT ISKAKGQPRE PQVYTLPPSR DELTKNQVSL TCLVKGFYPS DIAVEWESNG QPENNYKTTP PVLDSDGSFF LYSKLTVDKS RWQQGNVFSC SVMHEALHNH YTQKSLSLSP GK |
| TALL-1-consensus | 1479 | MFHDCKWDLL TKQWVCHGLG GGGGVDKTHT CPPCPAPELL GGPSVFLFPP KPKDTLMISR TPEVTCVVVD VSHEDPEVKF NWYVDGVEVH NAKTKPREEQ YNSTYRVVSV LTVLHQDWLN GKEYKCKVSN KALPAPIEKT ISKAKGQPRE PQVYTLPPSR DELTKNQVSL TCLVKGFYPS DIAVEWESNG QPENNYKTTP PVLDSDGSFF LYSKLTVDKS RWQQGNVFSC SVMHEALHNH YTQKSLSLSP GK |
| TALL-1 12-3 tandem dimer | 1480 | MLPGCKWDLL IKQWVCDPLG SGSATGGSGS TASSGSGSAT HMLPGCKWDL LIKQWVCDPL GGGGGVDKTH TCPPCPAPEL LGGPSVFLFP PKPKDTLMIS RTPEVTCVVV DVSHEDPEVK FNWYVDGVEV HNAKTKPREE QYNSTYRVVS VLTVLHQDWL NGKEYKCKVS NKALPAPIEK TISKAKGQPR EPQVYTLPPS RDELTKNQVS LTCLVKGFYP SDIAVEWESN GQPENNYKTT PPVLDSDGSF FLYSKLTVDK SRWQQGNVFS CSVMHEALHN HYTQKSLSLS PGK |
| TALL-1 consensus tandem dimer | 1481 | MFHDCKWDLL TKQWVCHGLG SGSATGGSGS TASSGSGSAT HMFHDCKWDL LTKQWVCHGL GGGGGVDKTH TCPPCPAPEL LGGPSVFLFP PKPKDTLMIS RTPEVTCVVV DVSHEDPEVK FNWYVDGVEV HNAKTKPREE QYNSTYRVYS VLTVLHQDWL NGKEYKCKVS NKALPAPIEK TISKAKGQPR EPQVYTLPPS RDELTKNQVS LTCLVKGFYP SDIAVEWESN GQPENNYKTT PPVLDSDGSF FLYSKLTVDK SRWQQGNVFS CSVMHEALHN HYTQKSLSLS PGK |

TABLE 32

ANG-2 INHIBITOR PEPTIDES

| PEPTIDE | SEQ ID NO. | PEPTIDE SEQUENCE |
|---|---|---|
| Con4-44 | 1482 | PIRQEECDWDPWTCEHMWEV |
| Con4-40 | 1483 | TNIQEECWDPWTCDHMPGK |
| Con4-4 | 1484 | WYEQDACEWDPWTCEHMAEV |
| Con4-31 | 1485 | NRLQEVCEWDPWTCEHMENV |
| Con4-C5 | 1486 | AATQEECEWDPWTCEHMPRS |
| Con4-42 | 1487 | LRHQEGCEWDPWTCEHMFDW |
| Con4-35 | 1488 | VPRQKDCEWDPWTCEHMYVG |
| Con4-43 | 1489 | SISHEECEWDPWTCEHMQVG |
| Con4-49 | 1490 | WAAQEECEWDPWTCEHMGRM |
| Con4-27 | 1491 | TWPQDKCEWDPWTCEHMGST |
| Con4-48 | 1492 | GHSQEECGWDPWTCEHMGTS |
| Con4-46 | 1493 | QHWQEECEWDPWTCDHMPSK |
| Con4-41 | 1494 | NVRQEKCEWDPWTCEHMPVR |
| Con4-36 | 1495 | KSGQVECNWDPWTCEHMPRN |
| Con4-34 | 1496 | VKTQEHCDWDPWTCEHMREW |
| Con4-28 | 1497 | AWGQEGCDWDPWTCEHMLPM |
| Con4-39 | 1498 | PVNQEDCWDPWTCEHMPPM |
| Con4-25 | 1499 | RAPQEDCEWDPWTCAHMDIK |
| Con4-50 | 1500 | HGQNMECEWDPWTCEHMFRY |
| Con4-38 | 1501 | PRLQEECVWDPWTCEHMPLR |
| Con4-29 | 1502 | RTTQEKCEWDPWTCEHMESQ |
| Con4-47 | 1503 | QTSQEDCVWDPWTCDHMVSS |
| Con4-20 | 1504 | QVIGRPCEWDPWTCEHLEGL |
| Con4-45 | 1505 | WAQQEECAWDPWTCDHMVGL |
| Con4-37 | 1506 | LPGQEDCEWDPWTCEHMVRS |
| Con4-33 | 1507 | PMNQVECDWDPWTCEHMPRS |
| AC2-Con4 | 1508 | FGWSHGCEWDPWTCEHMGST |
| Con4-32 | 1509 | KSTQDDCDWDPWTCEHMVGP |
| Con4-17 | 1510 | GPRISTCQWDPWTCEHMDQL |
| Con4-8 | 1511 | STIGDMCEWDPWTCAHMQVD |
| AC4-Con4 | 1512 | VLGGQGCEWDPWTCRLLQGW |
| Con4-1 | 1513 | VLGGQGCQWDPWTCSHLEDG |
| Con4-C1 | 1514 | TTIGSMCEWDPWTCAHMQGG |
| Con4-21 | 1515 | TKGKSVCQWDPWTCSHMQSG |
| Con4-C2 | 1516 | TTIGSMCQWDPWTCAHMQGG |
| Con4-18 | 1517 | WVNEVVCEWDPWTCNHWDTP |
| Con4-19 | 1518 | VVQVGMCQWDPWTCKHMRLQ |
| Con4-16 | 1519 | AVGSQTCEWDPWTCAHLVEV |

TABLE 32-continued

ANG-2 INHIBITOR PEPTIDES

| PEPTIDE | SEQ ID NO. | PEPTIDE SEQUENCE |
|---|---|---|
| Con4-11 | 1520 | QGMKMFCEWDPWTCAHIVYR |
| Con4-C4 | 1521 | TTIGSMCQWDPWTCEHMQGG |
| Con4-23 | 1522 | TSQRVGCEWDPWTCQHLTYT |
| Con4-15 | 1523 | QWSWPPCEWDPWTCQTVWPS |
| Con4-9 | 1524 | GTSPSFCQWDPWTCSHMVQG |
| TN8-Con4* | 1525 | QEECEWDPWTCEHM |

TABLE 33

ANG-2 INHIBITOR PEPTIDES

| Peptide | SEQ ID NO. | Peptide Sequence |
|---|---|---|
| L1-1 | 1526 | QNYKPLDELDATLYEHFIFHYT |
| L1-2 | 1527 | LNFTPLDELEQTLYEQWTLQQS |
| L1-3 | 1528 | TKFNPLDELEQTLYEQWTLQHQ |
| L1-4 | 1529 | VKFKPLDALEQTLYEHWMFQQA |
| L1-5 | 1530 | VKYKPLDELDEILYEQQTFQER |
| L1-7 | 1531 | TNFMPMDDLEQRLYEQFILQQG |
| L1-9 | 1532 | SKFKPLDELEQTLYEQWTLQHA |
| L1-10 | 1533 | QKFQPLDELEQTLYEQFMLQQA |
| L1-11 | 1534 | QNFKPMDELEDTLYKQELFQHS |
| L1-12 | 1535 | YKFTPLDDLEQTLYEQWTLQHV |
| L1-13 | 1536 | QEYEPLDELDETLYNQWMFHQR |
| L1-14 | 1537 | SNFMPLDELEQTLYEQFMLQHQ |
| L1-15 | 1538 | QKYQPLDELDKTLYDQFMLQQG |
| L1-16 | 1539 | QKFQPLDELEETLYKQWTLQQR |
| L1-17 | 1540 | VKYKPLDELDEWLYHQFTLHHQ |
| L1-18 | 1541 | QKFMPLDELDEILYEQFMFQQS |
| L1-19 | 1542 | QTFQPLDDLEEYLYEQWIRRYH |
| L1-20 | 1543 | EDYMPLDALDAQLYEQFILLHG |
| L1-21 | 1544 | HTFQPLDELEETLYYQWLYDQL |
| L1-22 | 1545 | YKFNPMDELEQTLYEEFLFQHA |
| AC6-L1 | 1546 | TNYKPLDELDATLYEHWILQHS |
| L1-C1 | 1547 | QKFKPLDELEQTLYEQWTLQQR |
| L1-C2 | 1548 | TKFQPLDELDQTLYEQWTLQQR |
| L1-C3 | 1549 | TNFQPLDELDQTLYEQWTLQQR |
| L1 | 1550 | KFNPLDELEETLYEQFTFQQ |

TABLE 34

ANG-2 INHIBITOR PEPTIDES

| Peptide | SEQ ID NO. | Sequence |
|---|---|---|
| Con1-1 | 1551 | AGGMRPYDGMLGWPNYDVQA |
| Con1-2 | 1552 | QTWDDPCMHILGPVTWRRCI |
| Con1-3 | 1553 | APGQRPYDGMLGWPTYQRIV |
| Con1-4 | 1554 | SGQLRPCEEIFGCGTQNLAL |
| Con1-5 | 1555 | FGDKRPLECMFGGPIQLCPR |
| Con1-6 | 1556 | GQDLRPCEDMFGCGTKDWYG |
| Con1 | 1557 | KRPCEEIFGGCTYQ |

TABLE 35

ANG-2 INHIBITOR PEPTIDES

| Peptide | SEQ ID NO: | Sequence |
|---|---|---|
| 12-9-1 | 1558 | GFEYCDGMEDPFTFGCDKQT |
| 12-9-2 | 1559 | KLEYCDGMEDPFTQGCDNQS |
| 12-9-3 | 1560 | LQEWCEGVEDPFTFGCEKQR |
| 12-9-4 | 1561 | AQDYCEGMEDPFTFGCEMQK |
| 12-9-5 | 1562 | LLDYCEGVQDPFTFGCENLD |
| 12-9-6 | 1563 | HQEYCEGMEDPFTFGCEYQG |
| 12-9-7 | 1564 | MLDYCEGMDDPFTFGCDKQM |
| 12-9-C2 | 1565 | LQDYCEGVEDPFTFGCENQR |
| 12-9-C1 | 1566 | LQDYCEGYEDPFTFGCEKQR |
| 12-9 | 1567 | FDYCEGVEDPFTFGCDNH |

TABLE 36

Ang-2 Binding Peptides

| Peptide | Seq Id No. | Sequence |
|---|---|---|
| TN8-8 | 1568 | KRPCEEMWGGCNYD |
| TN8-14 | 1569 | HQICKWDPWTCKHW |
| TN8-Con1 | 1570 | KRPCEEIFGGCTYQ |
| TN8-Con4 | 1571 | QEECEWDPWTCEHM |
| TN12-9 | 1572 | FDYCEGVEDPFTFGCDNH |
| L1 | 1573 | KFNPLDELEETLYEQFTFQQ |
| C17 | 1574 | QYGCDGFLYGCMIN |

TABLE 37

Ang-2 Binding Peptides

| Peptibody | Peptibody Sequence |
|---|---|
| L1 (N) | MGAQKFNPLDELEETLYEQFTFQQLEGGGGG-Fc (SEQ ID NO: 1575) |

TABLE 37-continued

Ang-2 Binding Peptides

| Peptibody | Peptibody Sequence |
|---|---|
| L1 (N) WT | MKFNPLDELEETLYEQFTFQQLEGGGGG-Fc (SEQ ID NO: 1576) |
| L1 (N) 1K WT | MKFNPLDELEETLYEQFTFQQGSGSATGGSGSTASSGSGSAT HLEGGGGG-Fc (SEQ ID NO: 1577) |
| 2xL1 (N) | MGAQKFNPLDELEETLYEQFTFQQGGGGGGGGGKFNPLDELE ETLYEQFTFQQLEGGGGG-Fc (SEQ ID NO: 1578) |
| 2xL1 (N) WT | MKFNPLDELEETLYEQFTFQQGGGGGGGGKFNPLDELEETLYE QFTFQQLEGGGGG-Fc (SEQ ID NO: 1579) |
| Con4 (N) | MGAQQEECEWDPWTCEHMLEGGGGG-Fc (SEQ ID NO: 1580) |
| Con4 (N) 1K-WT | MQEECEWDPWTCEHMGSGSATGGSGSTASSGSGSATHLEGG GGG-Fc (SEQ ID NO: 1581) |
| 2xCon4 (N) 1K | MGAQQEECEWDPWTCEHMGSGSATGGSGSTASSGSGSATH QEECEWDPWTCEHMLEGGGGG-Fc (SEQ ID NO: 1582) |
| L1 (C) | M-Fc-GGGGGAQKFNPLDELEETLYEQFTFQQLE (SEQ ID NO: 1583) |
| L1 (C) 1K | M-Fc-GGGGGAQGSGSATGGSGSTASSGSGSATHKFNPLDELEETLY EQFTFQQLE (SEQ ID NO: 1584) |
| 2xL1 (C) | M-Fc-GGGGGAQKFNPLDELEETLYEQFTFQQGGGGGGGGGKFNPLD ELEETLYEQFTFQQLE (SEQ ID NO: 1585) |
| Con4 (C) | M-Fc-GGGGGAQQEECEWDPWTCEHMLE (SEQ ID NO: 1586) |
| Con4 (C) 1K | M-Fc-GGGGGAQGSGSATGGSGSTASSGSGSATHQEECEWDPWTCE HMLE (SEQ ID NO: 1587) |
| 2xCon4 (C) 1K | M-Fc-GGGGGAQQEECEWDPWTCEHMGSGSATGGSGSTASSGSGS ATHQEECEWDPWTCEHMLE (SEQ ID NO: 1588) |
| Con4-L1 (N) | MGAQEECEWDPWTCEHMGGGGGGGGGKFNPLDELEETLYEQ FTFQQGSGSATGGSGSTASSGSGSATHLEGGGGG-Fc (SEQ ID NO: 1589) |
| Con4-L1 (C) | M-Fc-GGGGGAQGSGSATGGSGSTASSGSGSATHKFNPLDELEETLY EQFTFQQGGGGGQEECEWDPWTCEHMLE (SEQ ID NO: 1590) |
| TN-12-9 (N) | MGAQ-FDYCEGVEDPFTFGCDNHLE-GGGGG-Fc (SEQ ID NO: 1591) |
| C17 (N) | MGAQ-QYGCDGFLYGCMINLE-GGGGG-Fc (SEQ ID NO: 1592) |
| TN8-8 (N) | MGAQ-KRPCEEMWGGCNYDLEGGGGG-Fc (SEQ ID NO: 1593) |
| TN8-14 (N) | MGAQ-HQICKWDPWTCKHWLEGGGGG-Fc (SEQ ID NO: 1594) |
| Con1 (N) | MGAQ-KRPCEEIFGGCTYQLEGGGGG-Fc (SEQ ID NO: 1595) |

TABLE 38

Ang-2 Binding Peptides

| | Peptibody Sequence (Seq Id No:) |
|---|---|
| Con4 Derived Affinity-Matured Pbs | |
| Con4-44 (C) | M-Fc-GGGGGAQ-PIRQEECDWDPWTCEHMWEV-LE (SEQ ID NO: 1596) |
| Con4-40 (C) | M-Fc-GGGGGAQ-TNIQEECEWDPWTCDHMPGK-LE (SEQ ID NO: 1597) |
| Con4-4 (C) | M-Fc-GGGGGAQ-WYEQDACEWDPWTCEHMAEV-LE (SEQ ID NO: 1598) |
| Con4-31 (C) | M-Fc-GGGGGAQ-NRLQEVCEWDPWTCEHMENV-LE (SEQ ID NO: 1599) |
| Con4-C5 (C) | M-Fc-GGGGGAQ-AATQEECEWDPWTCEHMPRS-LE (SEQ ID NO: 1600) |
| Con4-42 (C) | M-Fc-GGGGGAQ-LRHQEGCEWDPWTCEHMFDW-LE (SEQ ID NO: 1602) |
| Con4-35 (C) | M-Fc-GGGGGAQ-VPRQKDCEWDPWTCEHMYVG-LE (SEQ ID NO: 1602) |
| Con4-43 (C) | M-Fc-GGGGGAQ-SISHEECEWDPWTCEHMQVG-LE (SEQ ID NO: 1603) |
| Con4-49 (C) | M-Fc-GGGGGAQ-WAAQEECEWDPWTCEHMGRM-LE (SEQ ID NO: 1604) |
| Con4-27 (C) | M-Fc-GGGGGAQ-TWPQDKCEWDPWTCEHMGST-LE (SEQ ID NO: 1605) |
| Con4-48 (C) | M-Fc-GGGGGAQ-GHSQEECGWDPWTCEHMGTS-LE (SEQ ID NO: 1606) |
| Con4-46 (C) | M-Fc-GGGGGAQ-QHWQEECEWDPWTCDHMPSK-LE (SEQ ID NO: 1607) |
| Con4-41 (C) | M-Fc-GGGGGAQ-NVRQEKCEWDPWTCEHMPVR-LE (SEQ ID NO: 1608) |
| Con4-36 (C) | M-Fc-GGGGGAQ-KSGQVECNWDPWTCEHMPRN-LE (SEQ ID NO: 1609) |
| Con4-34 (C) | M-Fc-GGGGGAQ-VKTQEHCDWDPWTCEHMREW-LE (SEQ ID NO: 1610) |
| Con4-28 (C) | M-Fc-GGGGGAQ-AWGQEGCDWDPWTCEHMLPM-LE (SEQ ID NO: 1611) |
| Con4-39 (C) | M-Fc-GGGGGAQ-PVNQEDCEWDPWTCEHMPPM-LE (SEQ ID NO: 1612) |
| Con4-25 (C) | M-Fc-GGGGGAQ-RAPQEDCEWDPWTCAHMDIK-LE (SEQ ID NO: 1613) |
| Con4-50 (C) | M-Fc-GGGGGAQ-HGQNMECEWDPWTCEHMFRY-LE (SEQ ID NO: 1614) |
| Con4-38 (C) | M-Fc-GGGGGAQ-PRLQEECVWDPWTCEHMPLR-LE (SEQ ID NO: 1615) |
| Con4-29 (C) | M-Fc-GGGGGAQ-RTTQEKCEWDPWTCEHMESQ-LE (SEQ ID NO: 1616) |
| Con4-47 (C) | M-Fc-GGGGGAQ-QTSQEDCVWDPWTCDHMVSS-LE (SEQ ID NO: 1617) |
| Con4-20 (C) | M-Fc-GGGGGAQ-QVIGRPCEWDPWTCEHLEGL-LE (SEQ ID NO: 1618) |
| Con4-45 (C) | M-Fc-GGGGGAQ-WAQQEECAWDPWTCDHMVGL-LE (SEQ ID NO: 1619) |

TABLE 38-continued

Ang-2 Binding Peptides

Peptibody Sequence (Seq Id No:)

Con4-37 (C)  M-Fc-GGGGGAQ-LPGQEDCEWDPWTCEHMVRS-LE
(SEQ ID NO: 1620)

Con4-33 (C)  M-Fc-GGGGGAQ-PMNQVECDWDPWTCEHMPRS-LE
(SEQ ID NO: 1621)

AC2-Con4 (C)  M-Fc-GGGGGAQ-FGWSHGCEWDPWTCEHMGST-LE
(SEQ ID NO: 1622)

Con4-32 (C)  M-Fc-GGGGGAQ-KSTQDDCDWDPWTCEHMVGP-LE
(SEQ ID NO: 1623)

Con4-17 (C)  M-Fc-GGGGGAQ-GPRISTCQWDPWTCEHMDQL-LE
(SEQ ID NO: 1624)

Con4-8 (C)  M-Fc-GGGGGAQ-STIGDMCEWDPWTCAHMQVD-LE
(SEQ ID NO: 1625)

AC4-Con4 (C)  M-Fc-GGGGGAQ-VLGGQGCEWDPWTCRLLQGW-LE
(SEQ ID NO: 1626)

Con4-1 (C)  M-Fc-GGGGGAQ-VLGGQGCQWDPWTCSHLEDG-LE
(SEQ ID NO: 1627)

Con4-C1 (C)  M-Fc-GGGGGAQ-TTIGSMCEWDPWTCAHMQGG-LE
(SEQ ID NO: 1628)

Con4-21 (C)  M-Fc-GGGGGAQ-TKGKSVCQWDPWTCSHMQSG-LE
(SEQ ID NO: 1629)

Con4-C2 (C)  M-Fc-GGGGGAQ-TTIGSMCQWDPWTCAHMQGG-LE
(SEQ ID NO: 1630)

Con4-18 (C)  M-Fc-GGGGGAQ-WVNEVVCEWDPWTCNHWDTP-LE
(SEQ ID NO: 1631)

Con4-19 (C)  M-Fc-GGGGGAQ-VVQVGMCQWDPWTCKHMRLQ-LE
(SEQ ID NO: 1632)

Con4-16 (C)  M-Fc-GGGGGAQ-AVGSQTCEWDPWTCAHLVEV-LE
(SEQ ID NO: 1633)

Con4-11 (C)  M-Fc-GGGGGAQ-QGMKMFCEWDPWTCAHIVYR-LE
(SEQ ID NO: 1634)

Con4-C4 (C)  M-Fc-GGGGGAQ-TTIGSMCQWDPWTCEHMQGG-LE
(SEQ ID NO: 1635)

Con4-23 (C)  M-Fc-GGGGGAQ-TSQRVGCEWDPWTCQHLTYT-LE
(SEQ ID NO: 1636)

Con4-15 (C)  M-Fc-GGGGGAQ-QWSWPPCEWDPWTCQTVWPS-LE
(SEQ ID NO: 1637)

Con4-9 (C)  M-Fc-GGGGGAQ-GTSPSFCQWDPWTCSHMVQG-LE
(SEQ ID NO: 1638)

Con4-10 (C)  M-Fc-GGGGGAQ-TQGLHQCEWDPWTCKVLWPS-LE
(SEQ ID NO: 1639)

Con4-22 (C)  M-Fc-GGGGGAQ-VWRSQVCQWDPWTCNLGGDW-LE
(SEQ ID NO: 1640)

Con4-3 (C)  M-Fc-GGGGGAQ-DKILEECQWDPWTCQFFYGA-LE
(SEQ ID NO: 1641)

Con4-5 (C)  M-Fc-GGGGGAQ-ATFARQCQWDPWTCALGGNW-LE
(SEQ ID NO: 1642)

Con4-30 (C)  M-Fc-GGGGOAQ-GPAQEECEWDPWTCEPLPLM-LE
(SEQ ID NO: 1643)

Con4-26 (C)  M-Fc-GGGGGAQ-RPEDMCSQWDPWTWHLQGYC-LE
(SEQ ID NO: 1644)

TABLE 38-continued

Ang-2 Binding Peptides

Peptibody Sequence (Seq Id No:)

Con4-7 (C)  M-Fc-GGGGGAQ-LWQLAVCQWDPQTCDHMGAL-LE
(SEQ ID NO: 1645)

Con4-12 (C)  M-Fc-GGGGGAQ-TQLVSLCEWDPWTCRLLDGW-LE
(SEQ ID NO: 1646)

Con4-13 (C)  M-Fc-GGGGGAQ-MGGAGRCEWDPWTCQLLQGW-LE
(SEQ ID NO: 1647)

Con4-14 (C)  M-Fc-GGGGGAQ-MFLPNECQWDPWTCSNLPEA-LE
(SEQ ID NO: 1648)

Con4-2 (C)  M-Fc-GGGGGAQ-FGWSHGCEWDPWTCRLLQGW-LE
(SEQ ID NO: 1649)

Con4-6 (C)  M-Fc-GGGGGAQ-WPQTEGCQWDPWTCRLLHGW-LE
(SEQ ID NO: 1650)

Con4-24 (C)  M-Fc-GGGGGAQ-PDTRQGCQWDPWTCRLYGMW-LE
(SEQ ID NO: 1651)

AC1-Con4 (C)  M-Fc-GGGGGAQ-TWPQDKCEWDPWTCRLLQGW-LE
(SEQ ID NO: 1652)

AC3-Con4 (C)  M-Fc-GGGGGAQ-DKILEECEWDPWTCRLLQGW-LE
(SEQ ID NO: 1653)

AC5-Con4 (C)  M-Fc-GGGGGAQ-AATQEECEWDPWTCRLLQGW-LE
(SEQ ID NO: 1654)

L1 Derived Affinity-Matured Pbs

L1-7 (N)  MGAQ-TNFMPMDDLEQRLYEQFILQQG-LEGGGGG-Fc
(SEQ ID NO: 1655)

AC6-L1 (N)  MGAQ-TNYKPLDELDATLYEHWILQHS LEGGGGG-Fc
(SEQ ID NO: 1656)

L1-15 (N)  MGAQ-QKYQPLDELDKTLYDQFMLQQG LEGGGGG-Fc
(SEQ ID NO: 1657)

L1-2 (N)  MGAQ-LNFTPLDELEQTLYEQWTLQQS LEGGGGG-Fc
(SEQ ID NO: 1658)

L1-10 (N)  MGAQ-QKFQPLDELEQTLYEQFMLQQA LEGGGGG-Fc
(SEQ ID NO: 1659)

L1-13 (N)  MGAQ-QEYEPLDELDETLYNQWMFHQR LEGGGGG-Fc
(SEQ ID NO: 1660)

L1-5 (N)  MGAQ-VKYKPLDELDEILYEQQTFQER LEGGGGG-Fc
(SEQ ID NO: 1661)

L1-C2 (N)  MGAQ-TKFQPLDELDQTLYEQWTLQQR LEGGGGG-Fc
(SEQ ID NO: 1662)

L1-C3 (N)  MGAQ-TNFQPLDELDQTLYEQWTLQQR LEGGGGG-Fc
(SEQ ID NO: 1663)

L1-11 (N)  MGAQ-QNFKPMDELEDTLYKQFLFQHS LEGGGGG-Fc
(SEQ ID NO: 1664)

L1-17 (N)  MGAQ-VKYKPLDELDEWLYHQFTLHHQ LEGGGGG-Fc
(SEQ ID NO: 1665)

L1-12 (N)  MGAQ-YKFTPLDDLEQTLYEQWTLQHV LEGGGGG-Fc
(SEQ ID NO: 1666)

L1-1 (N)  MGAQ-QNYKPLDELDATLYEHFIFHYT LEGGGGG-Fc
(SEQ ID NO: 1667)

L1-4 (N)  MGAQ-VKFKPLDALEQTLYEHWMFQQA LEGGGGG-Fc
(SEQ ID NO: 1668)

TABLE 38-continued

Ang-2 Binding Peptides

| | Peptibody Sequence (Seq Id No:) |
|---|---|
| L1-20 (N) | MGAQ-EDYMPLDALDAQLYEQFILLHG LEGGGGG-Fc (SEQ ID NO: 1669) |
| L1-22 (N) | MGAQ-YKFNPMDELEQTLYEEFLFQHA LEGGGGG-Fc (SEQ ID NO: 1670) |
| L1-14 (N) | MGAQ-SNFMPLDELEQTLYEQFMLQHQ LEGGGGG-Fc (SEQ ID NO: 1671) |
| L1-16 (N) | MGAQ-QKFQPLDELEETLYKQWTLQQR LEGGGGG-Fc (SEQ ID NO: 1672) |
| L1-18 (N) | MGAQ-QKFMPLDELDEILYEQFMFQQS LEGGGGG-Fc (SEQ ID NO: 1673) |
| L1-3 (N) | MGAQ-TKFNPLDELEQTLYEQWTLQHQ LEGGGGG-Fc (SEQ ID NO: 1674) |
| L1-21 (N) | MGAQ-HTFQPLDELEETLYYQWLYDQL LEGGGGG-Fc (SEQ ID NO: 1675) |
| L1-C1 (N) | MGAQ-QKFKPLDELEQTLYEQWTLQQR LEGGGGG-Fc (SEQ ID NO: 1676) |
| L1-19 (N) | MGAQ-QTFQPLDDLEEYLYEQWIRRYH LEGGGGG-Fc (SEQ ID NO: 1677) |
| L1-9 (N) | MGAQ-SKFKPLDELEQTLYEQWTLQHA LEGGGGG-Fc (SEQ ID NO: 1678) |
| Con1 Derived Affinity- Matured Pbs | |
| Con1-4 (C) | M-Fc-GGGGGAQ-SGQLRPCEEIFGCGTQNLAL-LE (SEQ ID NO: 1679) |
| Con1-1 (C) | M-Fc-GGGGGAQ-AGGMRPYDGMLGWPNYDVQA-LE (SEQ ID NO: 1680) |
| Con1-6 (C) | M-Fc-GGGGGAQ-GQDLRPCEDMFGCGTKDWYG-LE (SEQ ID NO: 1681) |
| Con1-3 (C) | M-Fc-GGGGGAQ-APGQRPYDGMLGWPTYQRIV-LE (SEQ ID NO: 1682) |
| Con1-2 (C) | M-Fc-GGGGGAQ-QTWDDPCMHILGPVTWRRCI-LE (SEQ ID NO: 1683) |
| Con1-5 (C) | M-Fc-GGGGGAQ-FGDKRPLECMFGGPIQLCPR-LE (SEQ ID NO: 1684) |
| Parent: Con1 (C) | M-Fc-GGGGGAQ-KRPCEEIFGGCTYQ-LE (SEQ ID NO: 1685) |
| 12-9 Derived Affinity- Matured Pbs | |
| 12-9-3 (C) | M-Fc-GGGGGAQ-LQEWCEGVEDPFTFGCEKQR-LE (SEQ ID NO: 1686) |
| 12-9-7 (C) | M-Fc-GGGGGAQ-MLDYCEGMDDPFTFGCDKQM-LE (SEQ ID NO: 1687) |
| 12-9-6 (C) | M-Fc-GGGGGAQ-HQEYCEGMEDPFTFGCEYQG-LE (SEQ ID NO: 1688) |
| 12-9-C2 (C) | M-Fc-GGGGGAQ-LQDYCEGVEDPFTFGCENQR-LE (SEQ ID NO: 1689) |
| 12-9-5 (C) | M-Fc-GGGGGAQ-LLDYCEGVQDPFTFGCENLD-LE (SEQ ID NO: 1690) |
| 12-9-1 (C) | M-Fc-GGGGGAQ-GFEYCDGMEDPFTFGCDKQT-LE (SEQ ID NO: 1691) |
| 12-9-4 (C) | M-Fc-GGGGGAQ-AQDYCEGMEDPFTFGCEMQK-LE (SEQ ID NO: 1692) |
| 12-9-C1 (C) | M-Fc-GGGGGAQ-LQDYCEGVEDPFTFGCEKQR-LE (SEQ ID NO: 1693) |
| 12-9-2 (C) | M-Fc-GGGGGAQ-KLEYCDGMEDPFTQGCDNQS-LE (SEQ ID NO: 1694) |
| Parent: 12-9 (C) | M-Fc-GGGGGAQ-FDYCEGVEDPFTFGCDNH-LE (SEQ ID NO: 1695) |

In addition to the TMP compounds set out in Table 6, the invention provides numerous other TMP compounds. In one aspect, TMP compounds comprise the following general structure:

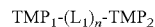

$$TMP_1\text{-}(L_1)_n\text{-}TMP_2$$

wherein $TMP_1$ and $TMP_2$ are each independently selected from the group of compounds comprising the core structure:

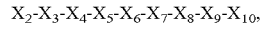

$$X_2\text{-}X_3\text{-}X_4\text{-}X_5\text{-}X_6\text{-}X_7\text{-}X_8\text{-}X_9\text{-}X_{10},$$

wherein,
$X_2$ is selected from the group consisting of Glu, Asp, Lys, and Val;
$X_3$ is selected from the group consisting of Gly and Ala;
$X_4$ is Pro;
$X_5$ is selected from the group consisting of Thr and Ser;
$X_6$ is selected from the group consisting of Leu, Ile, Val, Ala, and Phe;
$X_7$ is selected from the group consisting of Arg and Lys;
$X_8$ is selected from the group consisting of Gln, Asn, and Glu;
$X_9$ is selected from the group consisting of Trp, Tyr, and Phe;
$X_{10}$ is selected from the group consisting of Leu, Ile, Val, Ala, Phe, Met, and Lys;
$L_1$ is a linker as described herein; and
n is 0 or 1;
and physiologically acceptable salts thereof.

In one embodiment, $L_1$ comprises $(Gly)_n$, wherein n is 1 through 20, and when n is greater than 1, up to half of the Gly residues may be substituted by another amino acid selected from the remaining 19 natural amino acids or a stereoisomer thereof.

In addition to the core structure $X_2$-$X_{10}$ set forth above for $TMP_1$ and $TMP_2$, other related structures are also possible wherein one or more of the following is added to the $TMP_1$ and/or $TMP_2$ core structure: $X_1$ is attached to the N-terminus and/or $X_{11}$, $X_{12}$, $X_{13}$, and/or $X_{14}$ are attached to the C-terminus, wherein $X_1$, $X_{12}$, $X_{13}$, and $X_{14}$ are as follows:
$X_1$ is selected from the group consisting of Ile, Ala, Val, Leu, Ser, and Arg;
$X_{11}$ is selected from the group consisting of Ala, Ile, Val, Leu, Phe, Ser, Thr, Lys, His, and Glu;
$X_{12}$ is selected from the group consisting of Ala, Ile, Val, Leu, Phe, Gly, Ser, and Gln;
$X_{13}$ is selected from the group consisting of Arg, Lys, Thr, Val, Asn, Gln, and Gly; and
$X_{14}$ is selected from the group consisting of Ala, Ile, Val, Leu, Phe, Thr, Arg, Glu, and Gly.

TMP compounds of the invention are made up of, i.e., comprising, at least 9 subunits ($X_2$-$X_{10}$), wherein $X_2$-$X_{10}$ comprise the core structure. The $X_2$-$X_{14}$ subunits are amino acids independently selected from among the 20 naturally-occurring amino acids, however, the invention embraces compounds where $X_2$-$X_{14}$ are independently selected from the group of atypical, non-naturally occurring amino acids well known in the art. Specific amino acids are identified for each position. For example, $X_2$ may be Glu, Asp, Lys, or Val. Both three-letter and single letter abbreviations for amino acids are used herein; in each case, the abbreviations are the standard ones used for the 20 naturally-occurring amino acids or well-known variations thereof. These amino acids may have either L or D stereochemistry (except for Gly, which is neither L nor D), and the TMPs (as well as all other compounds of the invention) may comprise a combination of stereochemistries. The invention also provides reverse TMP molecules (as well as for all other peptides disclosed herein) wherein the amino terminal to carboxy terminal sequence of the amino acids is reversed. For example, the reverse of a molecule having the normal sequence $X_1$-$X_2$-$X_3$ would be $X_3$-$X_2$-$X_1$. The invention also provides retro-reverse TMP molecules (as well as for all other molecules of the invention described herein) wherein, like a reverse TMP, the amino terminal to carboxy terminal sequence of amino acids is reversed and residues that are normally "L" enantiomers in TMP are altered to the "D" stereoisomer form.

Exemplary TMP compounds of the invention therefore include without limitation the following compounds.

The present invention is also particularly useful with peptides having activity in treatment of:

cancer, wherein the peptide is a VEGF-mimetic or a VEGF receptor antagonist, a HER2 agonist or antagonist, a CD20 antagonist and the like;

asthma, wherein the protein of interest is a CKR3 antagonist, an IL-5 receptor antagonist, and the like;

thrombosis, wherein the protein of interest is a GPIIb antagonist, a GPIIIa antagonist, and the like;

autoimmune diseases and other conditions involving immune modulation, wherein the protein of interest is an IL-2 receptor antagonist, a CD40 agonist or antagonist, a CD40L agonist or antagonist, a thymopoietin mimetic and the like.

Derivatives. The invention also contemplates derivatizing the peptide and/or vehicle portion (as discussed below) of the compounds. Such derivatives may improve the solubility, absorption, biological half life, and the like of the compounds. The moieties may alternatively eliminate or attenuate any undesirable side-effect of the compounds and the like. Exemplary derivatives include compounds in which:

1. The compound or some portion thereof is cyclic. For example, the peptide portion may be modified to contain two or more Cys residues (e.g., in the linker), which could cyclize by disulfide bond formation. For citations to references on preparation of cyclized derivatives, see Table 2.

2. The compound is cross-linked or is rendered capable of cross-linking between molecules. For example, the peptide portion may be modified to contain one Cys residue and

| | |
|---|---|
| IEGPTLRQWLAARA-GPNG-IEGPTLRQWLAARA | (SEQ. ID NO: 993) |
| IEGPTLRQCLAARA-GGGGGGGG-IEGPTLRQCLAARA (cyclic) | (SEQ. ID NO: 994) |
| IEGPTLRQCLAARA-GGGGGGGG-IEGPTLRQCLAARA (linear) | (SEQ. ID NO: 995) |
| IEGPTLRQALAARA-GGGGGGGG-IEGPTLRQALAARA | (SEQ. ID NO: 996) |
| IEGPTLRQWLAARA-GGGKGGGG-IEGPTLRQWLAARA | (SEQ. ID NO: 997) |
| IEGPTLRQWLAARA-GGGK(BrAC)GGGG-IEGPTLRQWLAARA | (SEQ. ID NO: 998) |
| IEGPTLRQWLAARA-GGGCGGGG-IEGPTLRQWLAARA | (SEQ. ID NO: 999) |
| IEGPTLRQWLAARA-GGGK(PEG)GGGG-IEGPTLRQWLAARA | (SEQ. ID NO: 1000) |
| IEGPTLRQWLAARA-GGGC(PEG)GGGG-IEGPTLRQWLAARA | (SEQ. ID NO: 1001) |
| IEGPTLRQWLAARA-GGGNGSGG-IEGPTLRQWLAARA | (SEQ. ID NO: 1002) |
| IEGPTLRQWLAARA-GGGCGGGG-IEGPTLRQWLAARA<br>                               \|<br>IEGPTLRQWLAARA-GGGCGGGG-IEGPTLRQWLAARA | (SEQ. ID NO: 1003) |
| IEGPTLRQWLAARA-GGGGGGGG-IEGPTLRQWLAARA | (SEQ. ID NO: 1004) |
| Fc-IEGPTLRQWLAARA-GPNG-IEGPTLRQWLAARA | (SEQ. ID NO: 1005) |
| Fc-IEGPTLRQWLAARA-GPNG-IEGPTLRQWLAARA-Fc | (SEQ. ID NO: 1006) |
| IEGPTLRQWLAARA-GGGGGGGG-IEGPTLRQWLAARA-Fc | (SEQ. ID NO: 1007) |
| Fc-GG-IEGPTLRQWLAARA-GPNG-IEGPTLRQWLAARA | (SEQ. ID NO: 1008) |
| Fc-IEGPTLRQWLAARA-GGGGGGGG-IEGPTLRQWLAARA | (SEQ. ID NO: 1009) |
| Fc-IEGPTLRQCLAARA-GGGGGGGG-IEGPTLRQCLAARA (cyclic) | (SEQ. ID NO: 1010) |
| Fc-IEGPTLRQCLAARA-GGGGGGGG-IEGPTLRQCLAARA (linear) | (SEQ. ID NO: 1011) |
| Fc-IEGPTLRQALAARA-GGGGGGGG-IEGPTLRQALAARA | (SEQ. ID NO: 1012) |
| FC-IEGPTLRQWLAARA-GGGKGGGG-IEGPTLRQWLAARA | (SEQ. ID NO: 1013) |
| Fc-IEGPTLRQWLAARA-GGGCGGGG-IEGPTLRQWLAARA | (SEQ. ID NO: 1014) |
| Fc-IEGPTLRQWLAARA-GGGNGSGG-IEGPTLRQWLAARA | (SEQ. ID NO: 1015) |
| Fc-IEGPTLRQWLAARA-GGGCGGGG-IEGPTLRQWLAARA<br>                                 \|<br>Fc-IEGPTLRQWLAARA-GGGCGGGG-IEGPTLRQWLAARA | (SEQ. ID NO: 1016) |
| Fc-GGGGG-IEGPTLRQWLAARA-GGGGGGGG-IEGPTLRQWLAARA | (SEQ. ID NO: 1017) | thereby be able to form an intermolecular disulfide bond with a like molecule. The compound may also be cross-linked through its C-terminus, as in the molecule shown below.

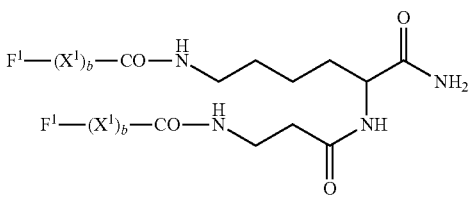

3. One or more peptidyl [—C(O)NR—] linkages (bonds) is replaced by a non-peptidyl linkage. Exemplary non-peptidyl linkages are —CH2-carbamate [—CH2-OC(O)NR—], phosphonate, —CH2-sulfonamide [—CH2-S(O)$_2$NR—], urea [—NHC(O)NH—], —CH2-secondary amine, and alkylated peptide [—C(O)NR6- wherein R6 is lower alkyl].

4. The N-terminus is derivatized. Typically, the N-terminus may be acylated or modified to a substituted amine. Exemplary N-terminal derivative groups include —NRR1 (other than —NH$_2$), —NRC(O)R1, —NRC(O)OR1, —NRS(O)$_2$R1, —NHC(O)NHR1, succinimide, or benzyloxycarbonyl-NH— (CBZ-NH—), wherein R and R1 are each independently hydrogen or lower alkyl and wherein the phenyl ring may be substituted with 1 to 3 substituents selected from the group consisting of C1-C4 alkyl, C1-C4 alkoxy, chloro, and bromo.

5. The free C-terminus is derivatized. Typically, the C-terminus is esterified or amidated. For example, one may use methods described in the art to add (NH—CH2-CH2-NH2)2 to compounds of this invention. Likewise, one may use methods described in the art to add —NH2 to compounds of this invention. Exemplary C-terminal derivative groups include, for example, —C(O)R2 wherein R2 is lower alkoxy or —NR3R4 wherein R3 and R4 are independently hydrogen or C1-C8 alkyl (preferably C1-C4 alkyl).

6. A disulfide bond is replaced with another, preferably more stable, cross-linking moiety (e.g., an alkylene). See, e.g., Bhatnagar et al. (1996), J. Med. Chem. 39: 3814-9; Alberts et al. (1993) Thirteenth Am. Pep. Symp., 357-9.

7. One or more individual amino acid residues is modified. Various derivatizing agents are known to react specifically with selected sidechains or terminal residues, as described in detail below.

Lysinyl residues and amino terminal residues may be reacted with succinic or other carboxylic acid anhydrides, which reverse the charge of the lysinyl residues. Other suitable reagents for derivatizing alpha-amino-containing residues include imidoesters such as methyl picolinimidate; pyridoxal phosphate; pyridoxal; chloroborohydride; trinitrobenzenesulfonic acid; O-methylisourea; 2,4 pentanedione; and transaminase-catalyzed reaction with glyoxylate.

Arginyl residues may be modified by reaction with any one or combination of several conventional reagents, including phenylglyoxal, 2,3-butanedione, 1,2-cyclohexanedione, and ninhydrin. Derivatization of arginyl residues requires that the reaction be performed in alkaline conditions because of the high pKa of the guanidine functional group. Furthermore, these reagents may react with the groups of lysine as well as the arginine epsilon-amino group.

Specific modification of tyrosyl residues has been studied extensively, with particular interest in introducing spectral labels into tyrosyl residues by reaction with aromatic diazonium compounds or tetranitromethane. Most commonly, N-acetylimidizole and tetranitromethane are used to form O-acetyl tyrosyl species and 3-nitro derivatives, respectively.

Carboxyl sidechain groups (aspartyl or glutamyl) may be selectively modified by reaction with carbodiimides (R'—N=C=N—R') such as 1-cyclohexyl-3-(2-morpholinyl-(4-ethyl)carbodiimide or 1-ethyl-3-(4-azonia-4,4-dimethylpentyl)carbodiimide. Furthermore, aspartyl and glutamyl residues may be converted to asparaginyl and glutaminyl residues by reaction with ammonium ions.

Glutaminyl and asparaginyl residues may be deamidated to the corresponding glutamyl and aspartyl residues. Alternatively, these residues are deamidated under mildly acidic conditions. Either form of these residues falls within the scope of this invention.

Cysteinyl residues can be replaced by amino acid residues or other moieties either to eliminate disulfide bonding or, conversely, to stabilize cross-linking. See, e.g., Bhatnagar et al. (1996), J. Med. Chem. 39: 3814-9.

Derivatization with bifunctional agents is useful for cross-linking the peptides or their functional derivatives to a water-insoluble support matrix or to other macromolecular vehicles. Commonly used cross-linking agents include, e.g., 1,1-bis(diazoacetyl)-2-phenylethane, glutaraldehyde, N-hydroxysuccinimide esters, for example, esters with 4-azidosalicylic acid, homobifunctional imidoesters, including disuccinimidyl esters such as 3,3'-dithiobis(succinimidylpropionate), and bifunctional maleimides such as bis-N-maleimido-1,8-octane. Derivatizing agents such as methyl-3-[(p-azidophenyl)dithio]propioimidate yield photoactivatable intermediates that are capable of forming crosslinks in the presence of light. Alternatively, reactive water-insoluble matrices such as cyanogen bromide-activated carbohydrates and the reactive substrates described in U.S. Pat. Nos. 3,969,287; 3,691,016; 4,195,128; 4,247,642; 4,229,537; and 4,330,440 are employed for protein immobilization.

Carbohydrate (oligosaccharide) groups may conveniently be attached to sites that are known to be glycosylation sites in proteins. Generally, O-linked oligosaccharides are attached to serine (Ser) or threonine (Thr) residues while N-linked oligosaccharides are attached to asparagine (Asn) residues when they are part of the sequence Asn-X-Ser/Thr, where X can be any amino acid except proline. X is preferably one of the 19 naturally occurring amino acids other than proline. The structures of N-linked and O-linked oligosaccharides and the sugar residues found in each type are different. One type of sugar that is commonly found on both is N-acetylneuraminic acid (referred to as sialic acid). Sialic acid is usually the terminal residue of both N-linked and O-linked oligosaccharides and, by virtue of its negative charge, may confer acidic properties to the glycosylated compound. Such site(s) may be incorporated in the linker of the compounds of this invention and are preferably glycosylated by a cell during recombinant production of the polypeptide compounds (e.g., in mammalian cells such as CHO, BHK, COS). However, such sites may further be glycosylated by synthetic or semi-synthetic procedures known in the art.

Other possible modifications include hydroxylation of proline and lysine, phosphorylation of hydroxyl groups of seryl or threonyl residues, oxidation of the sulfur atom in Cys, methylation of the alpha-amino groups of lysine, arginine, and histidine side chains. Creighton, Proteins: Structure and Molecule Properties (W. H. Freeman & Co., San Francisco), pp. 79-86 (1983).

Compounds of the present invention may be changed at the DNA level, as well. The DNA sequence of any portion of the compound may be changed to codons more compatible with the chosen host cell. For *E. coli*, which is the preferred host cell, optimized codons are known in the art. Codons may be substituted to eliminate restriction sites or to include silent restriction sites, which may aid in processing of the DNA in the selected host cell. The vehicle, linker and peptide DNA sequences may be modified to include any of the foregoing sequence changes.

Isotope- and toxin-conjugated derivatives. Another set of useful derivatives are the above-described molecules conjugated to toxins, tracers, or radioisotopes. Such conjugation is especially useful for molecules comprising peptide sequences that bind to tumor cells or pathogens. Such molecules may be used as therapeutic agents or as an aid to surgery (e.g., radioimmunoguided surgery or RIGS) or as diagnostic agents (e.g., radioimmunodiagnostics or RID).

As therapeutic agents, these conjugated derivatives possess a number of advantages. They facilitate use of toxins and radioisotopes that would be toxic if administered without the specific binding provided by the peptide sequence. They also can reduce the side-effects that attend the use of radiation and chemotherapy by facilitating lower effective doses of the conjugation partner.

Useful conjugation partners include:
radioisotopes, such as 90Yttrium, 131Iodine, 225Actinium, and 213Bismuth;
ricin A toxin, microbially derived toxins such as *Pseudomonas* endotoxin (e.g., PE38, PE40), and the like;
partner molecules in capture systems (see below);
biotin, streptavidin (useful as either partner molecules in capture systems or as tracers, especially for diagnostic use); and
cytotoxic agents (e.g., doxorubicin).

One useful adaptation of these conjugated derivatives is use in a capture system. In such a system, the molecule of the present invention would comprise a benign capture molecule. This capture molecule would be able to specifically bind to a separate effector molecule comprising, for example, a toxin or radioisotope. Both the vehicle-conjugated molecule and the effector molecule would be administered to the patient. In such a system, the effector molecule would have a short half-life except when bound to the vehicle-conjugated capture molecule, thus minimizing any toxic side-effects. The vehicle-conjugated molecule would have a relatively long half-life but would be benign and non-toxic. The specific binding portions of both molecules can be part of a known specific binding pair (e.g., biotin, streptavidin) or can result from peptide generation methods such as those described herein.

Such conjugated derivatives may be prepared by methods known in the art. In the case of protein effector molecules (e.g., *Pseudomonas* endotoxin), such molecules can be expressed as fusion proteins from correlative DNA constructs. Radioisotope conjugated derivatives may be prepared, for example, as described for the BEXA antibody (Coulter). Derivatives comprising cytotoxic agents or microbial toxins may be prepared, for example, as described for the BR96 antibody (Bristol-Myers Squibb). Molecules employed in capture systems may be prepared, for example, as described by the patents, patent applications, and publications from NeoRx. Molecules employed for RIGS and RID may be prepared, for example, by the patents, patent applications, and publications from NeoProbe.

Vehicles. The invention requires the presence of at least one vehicle attached to a peptide through the N-terminus, C-terminus or a sidechain of one of the amino acid residues. Multiple vehicles may also be used. In one aspect, an Fc domain is the vehicle. The Fc domain may be fused to the N or C termini of the peptides or at both the N and C termini.

In various embodiments of the invention, the Fc component is either a native Fc or an Fc variant. The immunoglobulin source of the native Fc is, in one aspect, of human origin and may, in alternative embodiments, be of any class of immunoglobulin. Native Fc domains are made up of monomeric polypeptides that may be linked into dimeric or multimeric forms by covalent (i.e., disulfide bonds) and/or non-covalent association. The number of intermolecular disulfide bonds between monomeric subunits of native Fc molecules ranges from one to four depending on class (e.g., IgG, IgA, IgE) or subclass (e.g., IgG1, IgG2, IgG3, IgA1, IgA2). One example of a native Fc is a disulfide-bonded dimer resulting from papain digestion of an IgG (see Ellison et al. (1982), Nucleic Acids Res. 10: 4071-9).

It should be noted that Fc monomers will spontaneously dimerize when the appropriate cysteine residues are present, unless particular conditions are present that prevent dimerization through disulfide bond formation. Even if the cysteine residues that normally form disulfide bonds in the Fc dimer are removed or replaced by other residues, the monomeric chains will generally form a dimer through non-covalent interactions. The term "Fc" herein is used to mean any of these forms: the native monomer, the native dimer (disulfide bond linked), modified dimers (disulfide and/or non-covalently linked), and modified monomers (i.e., derivatives).

As noted, Fc variants are suitable vehicles within the scope of this invention. A native Fc may be extensively modified to form an Fc variant, provided binding to the salvage receptor is maintained; see, for example WO 97/34631 and WO 96/32478. In such Fc variants, one may remove one or more sites of a native Fc that provide structural features or functional activity not required by the fusion molecules of this invention. One may remove these sites by, for example, substituting or deleting residues, inserting residues into the site, or truncating portions containing the site. The inserted or substituted residues may also be altered amino acids, such as peptidomimetics or D-amino acids. Fc variants may be desirable for a number of reasons, several of which are described below. Exemplary Fc variants include molecules and sequences in which:

1. Sites involved in disulfide bond formation are removed. Such removal may avoid reaction with other cysteine-containing proteins present in the host cell used to produce the molecules of the invention. For this purpose, the cysteine-containing segment at the N-terminus may be truncated or cysteine residues may be deleted or substituted with other amino acids (e.g., alanyl, seryl). Even when cysteine residues are removed, the single chain Fc domains can still form a dimeric Fc domain that is held together non-covalently.

2. A native Fc is modified to make it more compatible with a selected host cell. For example, one may remove the PA sequence near the N-terminus of a typical native Fc, which may be recognized by a digestive enzyme in *E. coli* such as proline iminopeptidase. One may also add an N-terminal methionine residue, especially when the molecule is expressed recombinantly in a bacterial cell such as *E. coli*.

3. A portion of the N-terminus of a native Fc is removed to prevent N-terminal heterogeneity when expressed in a selected host cell. For this purpose, one may delete any of the first 20 amino acid residues at the N-terminus, particularly those at positions 1, 2, 3, 4 and 5.

4. One or more glycosylation sites are removed. Residues that are typically glycosylated (e.g., asparagine) may confer cytolytic response. Such residues may be deleted or substituted with unglycosylated residues (e.g., alanine).

5. Sites involved in interaction with complement, such as the C1q binding site, are removed. For example, one may delete or substitute the EKK sequence of human IgG1. Complement recruitment may not be advantageous for the molecules of this invention and so may be avoided with such an Fc variant.

6. Sites are removed that affect binding to Fc receptors other than a salvage receptor. A native Fc may have sites for interaction with certain white blood cells that are not required for the fusion molecules of the present invention and so may be removed.

7. The ADCC site is removed. ADCC sites are known in the art; see, for example, Molec. Immunol. 29 (5): 633-9 (1992) with regard to ADCC sites in IgG1. These sites, as well, are not required for the fusion molecules of the present invention and so may be removed.

8. When the native Fc is derived from a non-human antibody, the native Fc may be humanized. Typically, to humanize a native Fc, one will substitute selected residues in the non-human native Fc with residues that are normally found in human native Fc. Techniques for antibody humanization are well known in the art.

An alternative vehicle would be a protein, polypeptide, peptide, antibody, antibody fragment, or small molecule (e.g., a peptidomimetic compound) capable of binding to a salvage receptor. For example, one could use as a vehicle a polypeptide as described in U.S. Pat. No. 5,739,277, issued Apr. 14, 1998 to Presta et al. Peptides could also be selected by phage display for binding to the FcRn salvage receptor. Such salvage receptor-binding compounds are also included within the meaning of "vehicle" and are within the scope of this invention. Such vehicles should be selected for increased half-life (e.g., by avoiding sequences recognized by proteases) and decreased immunogenicity (e.g., by favoring non-immunogenic sequences, as discovered in antibody humanization).

Variants, analogs or derivatives of the Fc portion may be constructed by, for example, making various substitutions of residues or sequences.

Variant (or analog) polypeptides include insertion variants, wherein one or more amino acid residues supplement an Fc amino acid sequence. Insertions may be located at either or both termini of the protein, or may be positioned within internal regions of the Fc amino acid sequence. Insertion variants, with additional residues at either or both termini, can include for example, fusion proteins and proteins including amino acid tags or labels. For example, the Fc molecule may optionally contain an N-terminal Met, especially when the molecule is expressed recombinantly in a bacterial cell such as E. coli.

In Fc deletion variants, one or more amino acid residues in an Fc polypeptide are removed. Deletions can be effected at one or both termini of the Fc polypeptide, or with removal of one or more residues within the Fc amino acid sequence. Deletion variants, therefore, include all fragments of an Fc polypeptide sequence.

In Fc substitution variants, one or more amino acid residues of an Fc polypeptide are removed and replaced with alternative residues. In one aspect, the substitutions are conservative in nature and conservative substitutions of this type are well known in the art. Alternatively, the invention embraces substitutions that are also non-conservative.

For example, cysteine residues can be deleted or replaced with other amino acids to prevent formation of some or all disulfide crosslinks of the Fc sequences. Each cysteine residue can be removed and/or substituted with other amino acids, such as Ala or Ser. As another example, modifications may also be made to introduce amino acid substitutions to (1) ablate the Fc receptor binding site; (2) ablate the complement (C1q) binding site; and/or to (3) ablate the antibody dependent cell-mediated cytotoxicity (ADCC) site. Such sites are known in the art, and any known substitutions are within the scope of Fc as used herein. For example, see Molecular Immunology, Vol. 29, No. 5, 633-639 (1992) with regard to ADCC sites in IgG1.

Likewise, one or more tyrosine residues can be replaced by phenylalanine residues. In addition, other variant amino acid insertions, deletions and/or substitutions are also contemplated and are within the scope of the present invention. Conservative amino acid substitutions will generally be preferred. Furthermore, alterations may be in the form of altered amino acids, such as peptidomimetics or D-amino acids.

Fc sequences of the compound may also be derivatized as described herein for peptides, i.e., bearing modifications other than insertion, deletion, or substitution of amino acid residues. Preferably, the modifications are covalent in nature, and include for example, chemical bonding with polymers, lipids, other organic, and inorganic moieties. Derivatives of the invention may be prepared to increase circulating half-life, or may be designed to improve targeting capacity for the polypeptide to desired cells, tissues, or organs.

It is also possible to use the salvage receptor binding domain of the intact Fc molecule as the Fc part of a compound of the invention, such as described in WO 96/32478, entitled "Altered Polypeptides with Increased Half-Life." Additional members of the class of molecules designated as Fc herein are those that are described in WO 97/34631, entitled "Immunoglobulin-Like Domains with Increased Half-Lives." Both of the published PCT applications cited in this paragraph are hereby incorporated by reference.

WSP components. Compounds of the invention further include at least one WSP. The WPS moiety of the molecule may be branched or unbranched. For therapeutic use of the end-product preparation, the polymer is pharmaceutically acceptable. In general, a desired polymer is selected based on such considerations as whether the polymer conjugate will be used therapeutically, and if so, the desired dosage, circulation time, resistance to proteolysis, and other considerations. In various aspects, the average molecular weight of each water soluble polymer is between about 2 kDa and about 100 kDa, between about 5 kDa and about 50 kDa, between about 12 kDa and about 40 kDa and between about 20 kDa and about 35 kDa. In yet another aspect the molecular weight of each polymer is between about 6 kDa and about 25 kDa. The term "about" as used herein and throughout, indicates that in preparations of a water soluble polymer, some molecules will weigh more, some less, than the stated molecular weight. Generally, the higher the molecular weight or the more branches, the higher the polymer/protein ratio. Other sizes may be used, depending on the desired therapeutic profile including for example, the duration of sustained release; the effects, if any, on biological activity; the ease in handling; the degree or lack of antigenicity and other known effects of a water soluble polymer on a therapeutic protein.

The WSP should be attached to a peptide or protein with consideration given to effects on functional or antigenic domains of the peptide or protein. In general, chemical derivatization may be performed under any suitable condition used to react a protein with an activated polymer molecule. Activating groups which can be used to link the water soluble polymer to one or more proteins include without limitation sulfone, maleimide, sulfhydryl, thiol, triflate, tresylate, azidirine, oxirane and 5-pyridyl. If attached to the peptide by reductive alkylation, the polymer selected should have a single reactive aldehyde so that the degree of polymerization is controlled.

Suitable, clinically acceptable, water soluble polymers include without limitation, PEG, polyethylene glycol propionaldehyde, copolymers of ethylene glycol/propylene glycol, monomethoxy-polyethylene glycol, carboxymethylcellulose, polyacetals, polyvinyl alcohol (PVA), polyvinyl pyrrolidone, poly-1,3-dioxolane, poly-1,3,6-trioxane, ethylene/maleic anhydride copolymer, poly (.beta.-amino acids) (either homopolymers or random copolymers), poly(n-vinyl pyrrolidone)polyethylene glycol, propropylene glycol homopolymers (PPG) and other polyakylene oxides, polypropylene oxide/ethylene oxide copolymers, polyoxyethylated polyols (POG) (e.g., glycerol) and other polyoxyethylated polyols, polyoxyethylated sorbitol, or polyoxyethylated glucose, colonic acids or other carbohydrate polymers, Ficoll or dextran and mixtures thereof.

Polysaccharide polymers are another type of water soluble polymer which may be used for protein modification. Dextrans are polysaccharide polymers comprised of individual subunits of glucose predominantly linked by α1-6 linkages. The dextran itself is available in many molecular weight ranges, and is readily available in molecular weights from about 1 kD to about 70 kD. Dextran is a suitable water soluble polymer for use in the present invention as a vehicle by itself or in combination with another vehicle (e.g., Fc). See, for example, WO 96/11953 and WO 96/05309. The use of dextran conjugated to therapeutic or diagnostic immunoglobulins has been reported; see, for example, European Patent Publication No. 0 315 456, which is hereby incorporated by reference. Dextran of about 1 kD to about 20 kD is preferred when dextran is used as a vehicle in accordance with the present invention.

In one embodiment, the WSP is PEG and the invention contemplates preparations wherein a compound is modified to include any of the forms of PEG that have been used to derivatize other proteins, such as and without limitation mono-(C1-C10) alkoxy- or aryloxy-polyethylene glycol. Polyethylene glycol propionaldehyde may have advantages in manufacturing due to its stability in water. The PEG group may be of any convenient molecular weight and may be linear or branched. The average molecular weight of PEG contemplated for use in the invention ranges from about 2 kDa to about 100 kDa, from about 5 kDa to about 50 kDa, from about 5 kDa to about 10 kDa. In another aspect, the PEG moiety has a molecular weight from about 6 kDa to about 25 kDa. PEG groups generally are attached to peptides or proteins via acylation or reductive alkylation through a reactive group on the PEG moiety (e.g., an aldehyde, amino, thiol, or ester group) to a reactive group on the target peptide or protein (e.g., an aldehyde, amino, or ester group). Using methods described herein, a mixture of polymer/peptide conjugate molecules can be prepared, and the advantage provided herein is the ability to select the proportion of polymer/peptide conjugate to include in the mixture. Thus, if desired, a mixture of peptides with various numbers of polymer moieties attached (i.e., zero, one or two) can be prepared with a predetermined proportion of polymer/protein conjugate.

A useful strategy for the PEGylation (other methods are discussed in more detail herein) of synthetic peptides consists of combining, through forming a conjugate linkage in solution, a peptide and a PEG moiety, each bearing a special functionality that is mutually reactive toward the other. The peptides can be easily prepared with conventional solid phase synthesis. The peptides are "preactivated" with an appropriate functional group at a specific site. The precursors are purified and fully characterized prior to reacting with the PEG moiety. Ligation of the peptide with PEG usually takes place in aqueous phase and can be easily monitored by reverse phase analytical HPLC. The PEGylated peptides can be easily purified by preparative HPLC and characterized by analytical HPLC, amino acid analysis and laser desorption mass spectrometry.

Linkers. Any "linker" group is optional, whether positioned between peptides, peptide and vehicle or vehicle and WSP. When present, its chemical structure is not critical, since it serves primarily as a spacer. The linker is preferably made up of amino acids linked together by peptide bonds. Thus, in preferred embodiments, the linker is made up of from 1 to 20 amino acids linked by peptide bonds, wherein the amino acids are selected from the 20 naturally occurring amino acids. Some of these amino acids may be glycosylated, as is well understood by those in the art. In a more preferred embodiment, the 1 to 20 amino acids are selected from glycine, alanine, proline, asparagine, glutamine, and lysine. Even more preferably, a linker is made up of a majority of amino acids that are sterically unhindered, such as glycine and alanine. Thus, preferred linkers are polyglycines (particularly (Gly)4, (Gly)5), poly(Gly-Ala), and polyalanines. Other specific examples of linkers are:

```
(Gly)3Lys(GLy)4           (SEQ ID NO: 1018);

(Gly)3AsnGlySer(Gly)2     (SEQ ID NO: 1019);

(Gly)3Cys(Gly)4           (SEQ ID NO: 1020);

and

GlyProAsnGlyGly           (SEQ ID NO: 1021).
```

To explain the above nomenclature, for example, (Gly)$_3$Lys(Gly)$_4$ means Gly-Gly-Gly-Lys-Gly-Gly-Gly-Gly. Combinations of Gly and Ala are also preferred. The linkers shown here are exemplary; linkers within the scope of this invention may be much longer and may include other residues.

Non-peptide linkers are also possible. For example, alkyl linkers such as —NH—(CH2)s-C(O)—, wherein s=2-20 could be used. These alkyl linkers may further be substituted by any non-sterically hindering group such as lower alkyl (e.g., C1-C6) lower acyl, halogen (e.g., Cl, Br), CN, NH2, phenyl, etc. An exemplary non-peptide linker is a PEG linker,

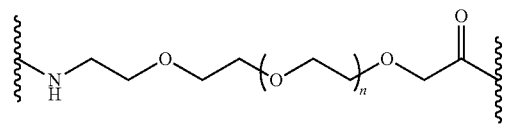

wherein n is such that the linker has a molecular weight of 100 to 5000 kD, preferably 100 to 500 kD. The peptide linkers may be altered to form derivatives in the same manner as described above.

Peptide production. A peptide having been identified may be made in transformed host cells using recombinant DNA techniques. If the vehicle component is a polypeptide, the peptide-vehicle fusion product may be expressed as one. To do so, a recombinant DNA molecule encoding the peptide is first prepared using methods well known in the art. For instance, sequences coding for the peptides could be excised from DNA using suitable restriction enzymes. Alternatively, the DNA molecule could be synthesized using chemical synthesis techniques, such as the phosphoramidate method. Also, a combination of these techniques could be used. The invention therefore provides polynucleotides encoding a compound of the invention.

The invention also provides vectors encoding compounds of the invention in an appropriate host. The vector comprises the polynucleotide that encodes the compound operatively linked to appropriate expression control sequences. Methods of effecting this operative linking, either before or after the polynucleotide is inserted into the vector, are well known. Expression control sequences include promoters, activators, enhancers, operators, ribosomal binding sites, start signals, stop signals, cap signals, polyadenylation signals, and other signals involved with the control of transcription or translation.

The resulting vector having the polynucleotide therein is used to transform an appropriate host. This transformation may be performed using methods well known in the art.

Any of a large number of available and well-known host cells may be used in the practice of this invention. The selection of a particular host is dependent upon a number of factors recognized by the art. These include, for example, compatibility with the chosen expression vector, toxicity of the peptides encoded by the DNA molecule, rate of transformation, ease of recovery of the peptides, expression characteristics, bio-safety and costs. A balance of these factors must be struck with the understanding that not all hosts may be equally effective for the expression of a particular DNA sequence. Within these general guidelines, useful microbial hosts include bacteria (such as *E. coli*), yeast (such as *Saccharomyces*) and other fungi, insects, plants, mammalian (including human) cells in culture, or other hosts known in the art.

Next, the transformed host is cultured and purified. Host cells may be cultured under conventional fermentation conditions so that the desired compounds are expressed. Such fermentation conditions are well known in the art. Finally, the peptides are purified from culture by methods well known in the art.

Depending on the host cell utilized to express a compound of the invention, carbohydrate (oligosaccharide) groups may conveniently be attached to sites that are known to be glycosylation sites in proteins. Generally, O-linked oligosaccharides are attached to serine (Ser) or threonine (Thr) residues while N-linked oligosaccharides are attached to asparagine (Asn) residues when they are part of the sequence Asn-X-Ser/Thr, where X can be any amino acid except proline. X is preferably one of the 19 naturally occurring amino acids not counting proline. The structures of N-linked and O-linked oligosaccharides and the sugar residues found in each type are different. One type of sugar that is commonly found on both is N-acetylneuraminic acid (referred to as sialic acid). Sialic acid is usually the terminal residue of both N-linked and O-linked oligosaccharides and, by virtue of its negative charge, may confer acidic properties to the glycosylated compound. Such site(s) may be incorporated in the linker of the compounds of this invention and are preferably glycosylated by a cell during recombinant production of the polypeptide compounds (e.g., in mammalian cells such as CHO, BHK, COS). However, such sites may further be glycosylated by synthetic or semi-synthetic procedures known in the art.

Alternatively, the compounds may be made by synthetic methods. For example, solid phase synthesis techniques may be used. Suitable techniques are well known in the art, and include those described in Merrifield (1973), Chem. Polypeptides, pp. 335-61 (Katsoyannis and Panayotis eds.); Merrifield (1963), J. Am. Chem. Soc. 85: 2149; Davis et al. (1985), Biochem. Intl. 10: 394-414; Stewart and Young (1969), Solid Phase Peptide Synthesis; U.S. Pat. No. 3,941,763; Finn et al. (1976), The Proteins (3rd ed.) 2: 105-253; and Erickson et al. (1976), The Proteins (3rd ed.) 2: 257-527. Solid phase synthesis is the preferred technique of making individual peptides since it is the most cost-effective method of making small peptides.

Compounds that contain derivatized peptides or which contain non-peptide groups are particularly amendable to synthesis by well-known organic chemistry techniques.

WSP modification. For obtaining a compound covalently attached to a WSP, any method described herein or otherwise known in the art is employed. Methods for preparing chemical derivatives of polypeptides will generally comprise the steps of (a) reacting the polypeptide with the activated polymer molecule (such as a reactive ester or aldehyde derivative of the polymer molecule) under conditions whereby the polypeptide becomes attached to one or more polymer molecules, and (b) obtaining the reaction product(s). The optimal reaction conditions will be determined based on known parameters and the desired result. For example, the larger the ratio of polymer molecules:protein, the greater the percentage of attached polymer molecule.

A biologically active molecule can be linked to a polymer through any available functional group using standard methods well known in the art. Examples of functional groups on either the polymer or biologically active molecule which can be used to form such linkages include amine and carboxy groups, thiol groups such as in cysteine resides, aldehydes and ketones, and hydroxy groups as can be found in serine, threonine, tyrosine, hydroxyproline and hydroxylysine residues.

The polymer can be activated by coupling a reactive group such as trichloro-s-triazine [Abuchowski, et al., (1977), J. Biol. Chem. 252:3582-3586, incorporated herein by reference in its entirety], carbonylimidazole [Beauchamp, et al., (1983), Anal. Biochem. 131:25-33, incorporated herein by reference in its entirety], or succinimidyl succinate [Abuchowski, et al., (1984), Cancer Biochem. Biophys. 7:175-186, incorporated herein by reference in its entirety] in order to react with an amine functionality on the biologically active molecule. Another coupling method involves formation of a glyoxylyl group on one molecule and an aminooxy, hydrazide or semicarbazide group on the other molecule to be conjugated [Fields and Dixon, (1968), Biochem. J. 108:883-887; Gaertner, et al., (1992), Bioconjugate Chem. 3:262-268; Geoghegan and Stroh, (1992), Bioconjugate Chem. 3:138-146; Gaertner, et al., (1994), J. Biol. Chem. 269:7224-7230, each of which is incorporated herein by reference in its entirety]. Other methods involve formation of an active ester at a free alcohol group of the first molecule to be conjugated using chloroformate or disuccinimidylcarbonate, which can then be conjugated to an amine group on the other molecule to be coupled [Veronese, et al., (1985), Biochem. and Biotech. 11:141-152; Nitecki, et al., U.S. Pat. No. 5,089,261; Nitecki, U.S. Pat. No. 5,281,698, each of which is incorporated herein by reference in its entirety]. Other reactive groups which may be attached via free alcohol groups are set forth in Wright, EP 0539167A2 (incorporated herein by reference in its entirety), which also describes the use of imidates for coupling via free amine groups.

Another chemistry involves acylation of the primary amines of a target using the NHS-ester of methoxy-PEG (O-[(N-succinimidyloxycarbonyl)-methyl]-O'-methylpolyethylene glycol). Acylation with methoxy-PEG-NHS results in an amide linkage which will eliminate the charge from the original primary amine. Other methods utilize mild oxidation of a target under conditions selected to target the pendant diol of the penultimate glycosyl unit sialic acid for oxidation to an aldehyde. The resultant glycoaldehyde was then reacted with a methoxy-PEG-hydrazide (O-(Hydrazinocarbonylmethyl)-O'-methylpolyethylene glycol) to form a semi-stable hydrazone between PEG and target. The hydrazone is subsequently reduced by sodium cyanoborohydride to produce a stable PEG conjugate. See for example, U.S. Pat. No. 6,586,398 (Kinstler, et al., Jul. 1, 2003), incorporated herein by reference in its entirety.

In specific applications of techniques for chemical modification, for example, U.S. Pat. No. 4,002,531 (incorporated herein by reference in its entirety) states that reductive alkylation was used for attachment of polyethylene glycol molecules to an enzyme. U.S. Pat. No. 4,179,337 (incorporated herein by reference in its entirety) discloses PEG:protein conjugates involving, for example, enzymes and insulin. U.S. Pat. No. 4,904,584 (incorporated herein by reference in its entirety) discloses the modification of the number of lysine residues in proteins for the attachment of polyethylene glycol molecules via reactive amine groups. U.S. Pat. No. 5,834,594 (incorporated herein by reference in its entirety) discloses substantially non-immunogenic water soluble PEG:protein conjugates, involving for example, the proteins IL-2, interferon alpha, and IL-1ra. The methods of Hakimi et al. involve the utilization of unique linkers to connect the various free amino groups in the protein to PEG. U.S. Pat. Nos. 5,824,784 and 5,985,265 (each of which is incorporated herein by reference in its entirety) teach methods allowing for selectively N-terminally chemically modified proteins and analogs thereof, including G-CSF and consensus interferon. Importantly, these modified proteins have advantages as relates to protein stability, as well as providing for processing advantages.

WSP modification is also described in Francis et al., In: Stability of protein pharmaceuticals: in vivo pathways of degradation and strategies for protein stabilization (Eds. Ahern., T. and Manning, M. C.) Plenum, N.Y., 1991 (incorporated herein by reference in its entirety), is used. In still another aspect, the method described in Delgado et al., "Coupling of PEG to Protein By Activation With Tresyl Chloride, Applications In Immunoaffinity Cell Preparation", In: Fisher et al., eds., Separations Using Aqueous Phase Systems, Applications In Cell Biology and Biotechnology, Plenum Press, N.Y. N.Y., 1989 pp. 211-213 (incorporated herein by reference in its entirety), which involves the use of tresyl chloride, which results in no linkage group between the WSP moiety and the polypeptide moiety. In other aspects, attachment of a WSP is effected through use of N-hydroxy succinimidyl esters of carboxymethyl methoxy polyethylene glycol, as well known in the art.

For other descriptions of modification of a target with a WSP, see, for example, U.S. patent application No. 20030096400; EP 0 442724A2; EP 0154316; EP 0401384; WO 94/13322; U.S. Pat. Nos. 5,362,852; 5,089,261; 5,281,698; 6,423,685; 6,635,646; 6,433,135; International application WO 90/07938; Gaertner and Offord, (1996), Bioconjugate Chem. 7:38-44; Greenwald et al., Crit. Rev Therap Drug Carrier Syst. 2000; 17:101-161; Kopecek et al., J Controlled Release., 74:147-158, 2001; Harris et al., Clin Pharmacokinet. 2001; 40(7):539-51; Zalipsky et al., Bioconjug Chem. 1997; 8:111-118; Nathan et al., Macromolecules. 1992; 25:4476-4484; Nathan et al., Bioconj Chem. 1993; 4:54-62; and Francis et al., Focus on Growth Factors, 3:4-10 (1992), the disclosures of which are incorporated herein by reference in their entirety.

Reductive alkylation. In one aspect, covalent attachment of a WSP is carried out by reductive alkylation chemical modification procedures as provided herein to selectively modify the N-terminal α-amino group, and testing the resultant product for the desired biological characteristic, such as the biological activity assays provided herein.

Reductive alkylation for attachment of a WSP to a protein or peptide exploits differential reactivity of different types of primary amino groups (e.g., lysine versus the N-terminal) available for derivatization in a particular protein. Under the appropriate reaction conditions, substantially selective derivatization of the protein at the N-terminus with a carbonyl group containing polymer is achieved.

For reductive alkylation, the polymer(s) selected could have a single reactive aldehyde group. A reactive aldehyde is, for example, polyethylene glycol propionaldehyde, which is water stable, or mono $C_1$-$C_{10}$ alkoxy or aryloxy derivatives thereof (see U.S. Pat. No. 5,252,714, incorporated herein by reference in its entirety). In one approach, reductive alkylation is employed to conjugate a PEG-aldehyde (O-(3-Oxopropyl)-O'-methylpolyethylene glycol) to a primary amine. Under appropriate conditions, this approach has been demonstrated to yield PEG conjugates predominately modified through the α-amine at the protein N-terminus.

An aldehyde functionality useful for conjugating the biologically active molecule can be generated from a functionality having adjacent amino and alcohol groups. In a polypeptide, for example, an N-terminal serine, threonine or hydroxylysine can be used to generate an aldehyde functionality via oxidative cleavage under mild conditions using periodate. These residues, or their equivalents, can be normally present, for example at the N-terminus of a polypeptide, may be exposed via chemical or enzymatic digestion, or may be introduced via recombinant or chemical methods. The reaction conditions for generating the aldehyde typically involve addition of a molar excess of sodium meta periodate and under mild conditions to avoid oxidation at other positions in the protein. The pH is preferably about 7.0. A typical reaction involves the addition of a 1.5 fold molar excess of sodium meta periodate, followed by incubation for 10 minutes at room temperature in the dark.

The aldehyde functional group can be coupled to an activated polymer containing a hydrazide or semicarbazide functionality to form a hydrazone or sernicarbazone linkage. Hydrazide-containing polymers are commercially available, and can be synthesized, if necessary, using standard techniques. PEG hydrazides for use in the invention can be obtained from Shearwater Polymers, Inc., 2307 Spring Branch Road, Huntsville, Ala. 35801 (now part of Nektar Therapeutics, 150 Industrial Road, San Carlos, Calif. 94070-6256). The aldehyde is coupled to the polymer by mixing the solution of the two components together and heating to about 37° C. until the reaction is substantially complete. An excess of the polymer hydrazide is typically used to increase the amount of conjugate obtained. A typical reaction time is 26 hours. Depending on the thermal stability of the reactants, the reaction temperature and time can be altered to provide suitable results. Detailed determination of reaction conditions for both oxidation and coupling is set forth in Geoghegan and Stroh, (1992), Bioconjugate Chem. 3:138-146, and in Geoghegan, U.S. Pat. No. 5,362,852, each of which is incorporated herein by reference in its entirety.

Using reductive alkylation, the reducing agent should be stable in aqueous solution and preferably be able to reduce only the Schiff base formed in the initial process of reductive alkylation. Reducing agents are selected from, and without limitation, sodium borohydride, sodium cyanoborohydride, dimethylamine borate, timethylamine borate and pyridine borate.

The reaction pH affects the ratio of polymer to protein to be used. In general, if the reaction pH is lower than the $pK_a$ of a target reactive group, a larger excess of polymer to protein will be desired. If the pH is higher than the target $pK_a$, the polymer:protein ratio need not be as large (i.e., more reactive groups are available, so fewer polymer molecules are needed).

Accordingly, the reaction is performed in one aspect at a pH which allows one to take advantage of the $pK_a$ differences between the ε-amino groups of the lysine residues and that of the α-amino group of the N-terminal residue of the protein. By such selective derivatization, attachment of a water soluble polymer to a protein is controlled; the conjugation with the polymer takes place predominantly at the N-terminus of the protein and no significant modification of other reactive groups, such as the lysine side chain amino groups, occurs.

In one aspect, therefore, methods are provided for covalent attachment of a WSP to a target compound and which provide a substantially homogenous preparation of WSP/protein conjugate molecules, in the absence of further extensive purification as is required using other chemical modification chemistries. More specifically, if polyethylene glycol is used, methods described allow for production of an N-terminally PEGylated protein lacking possibly antigenic linkage groups, i.e., the polyethylene glycol moiety is directly coupled to the protein moiety without potentially toxic by-products.

Depending on the method of WSP attachment chosen, the proportion of WSP molecules attached to the target peptide or protein molecule will vary, as will their concentrations in the reaction mixture. In general, the optimum ratio (in terms of efficiency of reaction in that there is no excess unreacted protein or polymer) is determined by the molecular weight of the WSP selected. In addition, when using methods that involve non-specific attachment and later purification of a desired species, the ratio may depend on the number of reactive groups (typically amino groups) available.

Purification. The method of obtaining a substantially homogeneous WSP-modified preparation is, in one aspect, by purification of a predominantly single species of modified compound from a mixture of species. By way of example, a substantially homogeneous species is first separated by ion exchange chromatography to obtain material having a charge characteristic of a single species (even though other species having the same apparent charge may be present), and then the desired species is separated using size exclusion chromatography. Other methods are reported and contemplated by the invention, includes for example, PCT WO 90/04606, published May 3, 1990, which describes a process for fractionating a mixture of PEG-protein adducts comprising partitioning the PEG/protein adducts in a PEG-containing aqueous biphasic system.

Thus, one aspect of the present invention is a method for preparing a WSP-modified compound conjugate comprised of (a) reacting a compound having more than one amino group with a water soluble polymer moiety under reducing alkylation conditions, at a pH suitable to selectively activate the α-amino group at the amino terminus of the protein moiety so that said water soluble polymer selectively attaches to said α-amino group; and (b) obtaining the reaction product. Optionally, and particularly for a therapeutic product, the reaction products are separated from unreacted moieties.

As ascertained by peptide mapping and N-terminal sequencing, a preparation is provided which comprises at least 50% PEGylated peptide in a mixture of PEGylated peptide and unreacted peptide. In other embodiments, preparations are provided which comprises at least 75% PEGylated peptide in a mixture of PEGylated peptide and unreacted peptide; at least 85% PEGylated peptide in a mixture of PEGylated peptide and unreacted peptide; at least 90% PEGylated peptide in a mixture of PEGylated peptide and unreacted peptide; at least 95% PEGylated peptide in a mixture of PEGylated peptide and unreacted peptide; and at least 99% PEGylated peptide in a mixture of PEGylated peptide and unreacted peptide.

Pharmaceutical Compositions. The present invention further provides pharmaceutical compositions comprising a preparation of the invention. Such pharmaceutical compositions may be for administration for injection, or for oral, nasal, transdermal or other forms of administration, including, e.g., by intravenous, intradermal, intramuscular, intramammary, intraperitoneal, intrathecal, intraocular, retrobulbar, intrapulmonary (e.g., aerosolized drugs) or subcutaneous injection (including depot administration for long term release); by sublingual, anal, vaginal, or by surgical implantation, e.g., embedded under the splenic capsule, brain, or in the cornea. The treatment may consist of a single dose or a plurality of doses over a period of time. In general, comprehended by the invention are pharmaceutical compositions comprising effective amounts of a compound of the invention together with pharmaceutically acceptable diluents, preservatives, solubilizers, emulsifiers, adjuvants and/or carriers. Such compositions include diluents of various buffer content (e.g., Tris-HCl, acetate, phosphate), pH and ionic strength; additives such as detergents and solubilizing agents (e.g., Tween 80, Polysorbate 80), anti-oxidants (e.g., ascorbic acid, sodium metabisulfite), preservatives (e.g., Thimersol, benzyl alcohol) and bulking substances (e.g., lactose, mannitol); incorporation of the material into particulate preparations of polymeric compounds such as polylactic acid, polyglycolic acid, etc. or into liposomes. Hyaluronic acid may also be used, and this may have the effect of promoting sustained duration in the circulation. The pharmaceutical compositions optionally may include still other pharmaceutically acceptable liquid, semisolid, or solid diluents that serve as pharmaceutical vehicles, excipients, or media, including but are not limited to, polyoxyethylene sorbitan monolaurate, magnesium stearate, methyl- and propylhydroxybenzoate, starches, sucrose, dextrose, gum acacia, calcium phosphate, mineral oil, cocoa butter, and oil of *theobroma*. Such compositions may influence the physical state, stability, rate of in vivo release, and rate of in vivo clearance of the present proteins and derivatives. See, e.g., Remington's Pharmaceutical Sciences, 18th Ed. (1990, Mack Publishing Co., Easton, Pa. 18042) pages 1435-1712 which are herein incorporated by reference. The compositions may be prepared in liquid form, or may be in dried powder, such as lyophilized form. Implantable sustained release formulations are also contemplated, as are transdermal formulations.

Oral Dosage. Contemplated for use herein are oral solid dosage forms, which are described generally in Chapter 89 of Remington's Pharmaceutical Sciences (1990), 18th Ed., Mack Publishing Co. Easton Pa. 18042, incorporated herein by reference. Solid dosage forms include tablets, capsules, pills, troches or lozenges, cachets or pellets. Alternatively, proteinoid encapsulation may be used (as, for example, proteinoid microspheres reported in U.S. Pat. No. 4,925,673), or liposomal encapsulation may be used, the liposomes optionally derivatized with various polymers (e.g., U.S. Pat. No. 5,013,556). A description of solid dosage forms for therapeutics in general is given in Chapter 10 of Marshall, K., Modern Pharmaceutics (1979), edited by G. S. Banker and C. T. Rhodes, incorporated herein by reference. In general, the formulation will include a preparation of the invention and inert ingredients which allow for protection against the stomach environment, and release of the biologically active material in the intestine.

If necessary, the compounds may be chemically modified so that oral delivery is efficacious. Generally, the chemical modification contemplated is the attachment of at least one moiety to the compound molecule itself, where said moiety permits (a) inhibition of proteolysis; and (b) uptake into the blood stream from the stomach or intestine. Also desired is the increase in overall stability of the compound and increase in circulation time in the body. Examples of such moieties include polyethylene glycol, copolymers of ethylene glycol and propylene glycol, carboxymethyl cellulose, dextran, polyvinyl alcohol, polyvinyl pyrrolidone and polyproline (Abuchowski and Davis, Soluble Polymer-Enzyme Adducts, Enzymes as Drugs, Hocenberg and Roberts, eds., Wiley-Interscience, New York, N.Y., (1981), pp 367-383; Newmark, et al., J. Appl. Biochem. 4:185-189 (1982)). Other polymers that could be used are poly-1,3-dioxolane and poly-1,3,6-tioxocane.

For oral delivery dosage forms, it is also possible to use a salt of a modified aliphatic amino acid, such as sodium N-(8-[2-hydroxybenzoyl]amino)caprylate (SNAC), as a carrier to enhance absorption of the therapeutic compound. The clinical efficacy of a heparin formulation using SNAC has been demonstrated in a Phase II trial conducted by Emisphere Technologies. See U.S. Pat. No. 5,792,451, "Oral drug delivery composition and methods."

Preparations of the invention can be included in formulation as fine multiparticulates in the form of granules or pellets of particle size about, for example, one mm. The formulation of the material for capsule administration could also be as a powder, lightly compressed plugs or even as tablets. Compositions are optionally prepared by compression.

Colorants and flavoring agents may be included. For example, the preparation may be formulated (such as by liposome or microsphere encapsulation) and then further contained within an edible product, such as a refrigerated beverage containing colorants and flavoring agents.

Preparations of the invention are, in one aspect, diluted or increased in the volume with an inert material. Exemplary diluents include carbohydrates, especially mannitol, α-lactose, anhydrous lactose, cellulose, sucrose, modified dextrans and starch. Certain inorganic salts may also be used as fillers including calcium triphosphate, magnesium carbonate and sodium chloride. Some commercially available diluents are Fast-Flo, Emdex, STA-Rx 1500, Emcompress and Avicell.

Preparations including disintegrants are further contemplated in solid dosage form compositions. Materials used as disintegrants include, but are not limited to, starch (including the commercial disintegrant based on starch, Explotab), sodium starch glycolate, Amberlite, sodium carboxymethylcellulose, ultramylopectin, sodium alginate, gelatin, orange peel, acid carboxymethyl cellulose, natural sponge and bentonite. Another form of disintegrant is an insoluble cationic exchange resin. Powdered gums may also be used as disintegrants and as binders and these can include powdered gums such as agar, Karaya or tragacanth. Alginic acid and its sodium salt are also useful as disintegrants.

Pharmaceutical compositions including binders are further contemplated to hold the therapeutic agent together to form a hard tablet and exemplary binders include materials from natural products such as acacia, tragacanth, starch and gelatin. Others include methyl cellulose (MC), ethyl cellulose (EC) and carboxymethyl cellulose (CMC). Polyvinyl pyrrolidone (PVP) and hydroxypropylmethyl cellulose (HPMC) could both be used in alcoholic solutions to granulate the therapeutic.

An antifrictional agent in a pharmaceutical composition is further contemplated to prevent sticking during the formulation process. Lubricants include, but are not limited to, stearic acid, including its magnesium and calcium salts, polytetrafluoroethylene (PTFE), liquid paraffin, vegetable oils and waxes. Soluble lubricants may also be used such as sodium lauryl sulfate, magnesium lauryl sulfate, polyethylene glycol of various molecular weights, Carbowax 4000 and 6000.

Glidants that might improve the flow properties of a pharmaceutical composition during formulation and to aid rearrangement during compression are also provided. Exemplary glidants include starch, talc, pyrogenic silica and hydrated silicoaluminate.

To aid dissolution of a composition into the aqueous environment, incorporation of a surfactant as a wetting agent is contemplated. Exemplary surfactants include anionic detergents such as sodium lauryl sulfate, dioctyl sodium sulfosuccinate and dioctyl sodium sulfonate. Cationic detergents are contemplated, including for example and without limitation, benzalkonium chloride or benzethonium chloride. In another aspect, compositions using as surfactants include lauromacrogol 400, polyoxyl 40 stearate, polyoxyethylene hydrogenated castor oil 10, 50 and 60, glycerol monostearate, polysorbate 40, 60, 65 and 80, sucrose fatty acid ester, methyl cellulose and carboxymethyl cellulose. Compositions comprising these surfactants, either alone or as a mixture in different ratios, are therefore further provided.

Optionally, additives are included in a pharmaceutical composition to enhance uptake of the compound, such additives including, for example and without limitation, fatty acids oleic acid, linoleic acid and linolenic acid.

Controlled release compositions. In another aspect, controlled release formulation are provided. A preparation of the invention is incorporated into an inert matrix which permits release by either diffusion or leaching mechanisms e.g., gums. Slowly degenerating matrices, e.g., alginates, polysaccharides, may also be incorporated into the formulation. Another form of a controlled release is by a method based on the Oros therapeutic system (Alza Corp.), i.e., the drug is enclosed in a semipermeable membrane which allows water to enter and push drug out through a single small opening due to osmotic effects. Some enteric coatings also have a delayed release effect.

Other coatings may be used in compositions of the invention, including for example, a variety of sugars which could be applied in a coating pan. The compositions also include a film coated tablet and the materials used in this instance are divided into two groups. The first includes the nonenteric materials, such as and without limitation methyl cellulose, ethyl cellulose, hydroxyethyl cellulose, methylhydroxy-ethyl cellulose, hydroxypropyl cellulose, hydroxypropyl-methyl cellulose, sodium carboxy-methyl cellulose, providone and the polyethylene glycols. The second group consists of the enteric materials that are commonly esters of phthalic acid.

A mix of materials is also contemplated to provide the optimum film coating. Film coating may be carried out in a pan coater or in a fluidized bed or by compression coating.

Pulmonary delivery. Also contemplated herein is pulmonary delivery of a preparation of the invention. The compound is delivered to the lungs of a mammal while inhaling and traverses across the lung epithelial lining to the blood stream. Pulmonary delivery is described in Adjei et al., Pharma. Res. (1990) 7: 565-9; Adjei et al. (1990), Internatl. J. Pharmaceutics 63: 135-44; Braquet et al. (1989), J. Cardiovasc. Pharmacol. 13 (suppl.5): s. 143-146; Hubbard et al. (1989), Annals Int. Med. 3: 206-12; Smith et al. (1989), J. Clin. Invest. 84: 1145-6; Oswein et al. (March 1990), "Aerosolization of Proteins", Proc. Symp. Resp. Drug Delivery II, Keystone, Colo.; Debs et al. (1988), J. Immunol. 140: 3482-8 and Platz et al., U.S. Pat. No. 5,284,656, the disclosures of which are incorporated herein by reference.

Mechanical devices. Also contemplated for practice of the invention is a wide range of mechanical devices designed for pulmonary delivery of therapeutic products, including but not limited to nebulizers, metered dose inhalers, and powder inhalers, all of which are familiar to those skilled in the art. Specific examples of commercially available devices suitable for the practice of this invention are the Ultravent nebulizer, manufactured by Mallinckrodt, Inc., St. Louis, Mo.; the Acorn II nebulizer, manufactured by Marquest Medical Products, Englewood, Colo.; the Ventolin metered dose inhaler, manufactured by Glaxo Inc., Research Triangle Park, N.C.; and the Spinhaler powder inhaler, manufactured by Fisons Corp., Bedford, Mass.

All such devices require the use of formulations suitable for the dispensing a preparation of the invention. Typically, each formulation is specific to the type of device employed and may involve the use of an appropriate propellant material, in addition to diluents, adjuvants and/or carriers useful in therapy.

For effective delivery to distal lung, the composition is prepared in particulate form with an average particle size in one aspect of less than 10 µm (or microns), and in an alternative aspect 0.5 to 5 µm.

Formulations suitable for use with a nebulizer, either jet or ultrasonic, will typically comprise the inventive compound dissolved in water at a concentration of about 0.1 to 25 mg of biologically active protein per mL of solution. The formulation may also include a buffer and a simple sugar (e.g., for protein stabilization and regulation of osmotic pressure). The nebulizer formulation may also contain a surfactant, to reduce or prevent surface induced aggregation of the protein caused by atomization of the solution in forming the aerosol.

Formulations for use with a metered-dose inhaler device will generally comprise a finely divided powder containing the inventive compound suspended in a propellant with the aid of a surfactant. The propellant may be any conventional material employed for this purpose, such as a chlorofluorocarbon, a hydrochlorofluorocarbon, a hydrofluorocarbon, or a hydrocarbon, including trichlorofluoromethane, dichlorodifluoromethane, dichlorotetrafluoroethanol, and 1,1,1,2-tetrafluoroethane, or combinations thereof. Suitable surfactants include sorbitan trioleate and soya lecithin. Oleic acid may also be useful as a surfactant.

Formulations for dispensing from a powder inhaler device will comprise a finely divided dry powder containing the inventive compound and may also include a bulking agent, such as lactose, sorbitol, sucrose, mannitol, trehalose, or xylitol in amounts which facilitate dispersal of the powder from the device, e.g., 50 to 90% by weight of the formulation.

Nasal delivery. Nasal delivery of preparations of the invention is also contemplated. Nasal delivery allows the passage of the protein to the blood stream directly after administering the therapeutic product to the nose, without the necessity for deposition of the product in the lung. Formulations for nasal delivery include those with dextran or cyclodextran. Delivery via transport across other mucous membranes is also contemplated.

Buccal delivery forms. Buccal delivery of the inventive compound is also contemplated. Buccal delivery formulations are known in the art for use with peptides.

Carriers. Pharmaceutically acceptable carriers include carbohydrates such as trehalose, mannitol, xylitol, sucrose, lactose, and sorbitol. Other ingredients for use in formulations may include DPPC, DOPE, DSPC and DOPC. Natural or synthetic surfactants may be used. PEG may be used (even apart from its use in derivatizing a compound of the invention). Dextrans, such as cyclodextran, may be used. Bile salts and other related enhancers may be used. Cellulose and cellulose derivatives may be used. Amino acids may be used, such as use in a buffer formulation.

Other formulations. The use of liposomes, microcapsules or microspheres, inclusion complexes, or other types of carriers is also contemplated.

Dosages. The dosage regimen involved in a method for treating a condition described herein will be determined by the attending physician, considering various factors which modify the action of drugs, e.g. the age, condition, body weight, sex and diet of the patient, the severity of any infection, time of administration and other clinical factors. In various aspects, the daily regimen is in the range of 0.1-1000 µg of a preparation per kilogram of body weight (calculating the mass of the protein alone, without chemical modification) or 0.1-150 µg/kg.

Preparations of the invention may be administered by an initial bolus followed by a continuous infusion to maintain therapeutic circulating levels of drug product. As another example, the inventive compound may be administered as a one-time dose. Those of ordinary skill in the art will readily optimize effective dosages and administration regimens as determined by good medical practice and the clinical condition of the individual patient. The frequency of dosing will depend on the pharmacokinetic parameters of the agents and the route of administration. The optimal pharmaceutical formulation will be determined by one skilled in the art depending upon the route of administration and desired dosage. See for example, Remington's Pharmaceutical Sciences, 18th Ed. (1990, Mack Publishing Co., Easton, Pa. 18042) pages 1435-1712, the disclosure of which is hereby incorporated by reference. Such formulations may influence the physical state, stability, rate of in vivo release, and rate of in vivo clearance of the administered agents. Depending on the route of administration, a suitable dose may be calculated according to body weight, body surface area or organ size. Further refinement of the calculations necessary to determine the appropriate dosage for treatment involving each of the above mentioned formulations is routinely made by those of ordinary skill in the art without undue experimentation, especially in light of the dosage information and assays disclosed herein, as well as the pharmacokinetic data observed in the human clinical trials discussed above. Appropriate dosages may be ascertained through use of established assays for determining blood levels dosages in conjunction with appropriate dose-response data. The final dosage regimen will be determined by the attending physician, considering various factors which modify the action of drugs, e.g. the drug's specific activity, the severity of the damage and the responsiveness of the patient, the age, condition, body weight, sex and diet of the patient, the severity of any infection, time of administration and other clinical factors. As studies are conducted, further information will emerge regarding the appropriate dosage levels and duration of treatment for various diseases and conditions.

The therapeutic methods, compositions and compounds of the present invention may also be employed, alone or in combination with other cytokines, soluble c-Mpl receptor, hematopoietic factors, interleukins, growth factors or antibodies in the treatment of disease states characterized by other symptoms as well as platelet deficiencies. It is anticipated that the preparations of the invention will prove useful in treating some forms of thrombocytopenia in combination with general stimulators of hematopoiesis, such as IL-3 or GM-CSF. Other megakaryocytic stimulatory factors, i.e., meg-CSF, stem cell factor (SCF), leukemia inhibitory factor (LIF), oncostatin M (OSM), or other molecules with megakaryocyte stimulating activity may also be employed with Mpl ligand. Additional exemplary cytokines or hematopoietic factors for such co-administration include IL-1 alpha, IL-1 beta, IL-2, IL-3, IL-4, IL-5, IL-6, IL-11, colony stimulating factor-1 (CSF-1), M-CSF, SCF, GM-CSF, granulocyte colony stimulating factor (G-CSF), EPO, interferon-alpha (IFN-alpha), consensus interferon, IFN-beta, IFN-gamma, IL-7, IL-8, IL-9, IL-10, IL-12, IL-13, IL-14, IL-15, IL-16, IL-17, IL-18, thrombopoietin (TPO), angiopoietins, for example Ang-1, Ang-2, Ang-4, Ang-Y, the human angiopoietin-like polypeptide, vascular endothelial growth factor (VEGF), angiogenin, bone morphogenic protein-1, bone morphogenic protein-2, bone morphogenic protein-3, bone morphogenic protein-4, bone morphogenic protein-5, bone morphogenic protein-6, bone morphogenic protein-7, bone morphogenic protein-8, bone morphogenic protein-9, bone morphogenic protein-10, bone morphogenic protein-11, bone morphogenic protein-12, bone morphogenic protein-13, bone morphogenic protein-14, bone morphogenic protein-15, bone morphogenic protein receptor IA, bone morphogenic protein receptor IB, brain derived neurotrophic factor, ciliary neutrophic factor, ciliary neutrophic factor receptor, cytokine-induced neutrophil chemotactic factor 1, cytokine-induced neutrophil, chemotactic factor $2\alpha$, cytokine-induced neutrophil chemotactic factor $2\beta$, $\beta$, endothelial cell growth factor, endothelin 1, epidermal growth factor, epithelial-derived neutrophil attractant, fibroblast growth factor 4, fibroblast growth factor 5, fibroblast growth factor 6, fibroblast growth factor 7, fibroblast growth factor 8, fibroblast growth factor 8b, fibroblast growth factor 8c, fibroblast growth factor 9, fibroblast growth factor 10, fibroblast growth factor acidic, fibroblast growth factor basic, glial cell line-derived neutrophic factor receptor $\alpha 1$, glial cell line-derived neutrophic factor receptor $\alpha 2$, growth related protein, growth related protein $\alpha$, growth related protein $\beta$, growth related protein y, heparin binding epidermal growth factor, hepatocyte growth factor, hepatocyte growth factor receptor, insulin-like growth factor I, insulin-like growth factor receptor, insulin-like growth factor II, insulin-like growth factor binding protein, keratinocyte growth factor, leukemia inhibitory factor, leukemia inhibitory factor receptor $\alpha$, nerve growth factor nerve growth factor receptor, neurotrophin-3, neurotrophin-4, placenta growth factor, placenta growth factor 2, platelet-derived endothelial cell growth factor, platelet derived growth factor, platelet derived growth factor A chain, platelet derived growth factor AA, platelet derived growth factor AB, platelet derived growth factor B chain, platelet derived growth factor BB, platelet derived growth factor receptor $\alpha$, platelet derived growth factor receptor $\beta$, pre-B cell growth stimulating factor, stem cell factor receptor, TNF, including TNF0, TNF1, TNF2, transforming growth factor $\alpha$, transforming growth factor $\beta$, transforming growth factor $\beta 1$, transforming growth factor $\beta 1.2$, transforming growth factor $\beta 2$, transforming growth factor $\beta 3$, transforming growth factor $\beta 5$, latent transforming growth factor $\beta 1$, transforming growth factor $\beta$ binding protein I, transforming growth factor $\beta$ binding protein II, transforming growth factor $\beta$ binding protein III, tumor necrosis factor receptor type I, tumor necrosis factor receptor type II, urokinase-type plasminogen activator receptor, vascular endothelial growth factor, and chimeric proteins and biologically or immunologically active fragments thereof. It may further be useful to administer, either simultaneously or sequentially, an effective amount of a soluble mammalian c-Mpl, which appears to have an effect of causing megakaryocytes to fragment into platelets once the megakaryocytes have reached mature form. Thus, administration of a preparation of the invention (to enhance the number of mature megakaryocytes) followed by administration of the soluble c-Mpl (to inactivate the ligand and allow the mature megakaryocytes to produce platelets) is expected to be a particularly effective means of stimulating platelet production. The dosage recited above would be adjusted to compensate for such additional components in the therapeutic composition. Progress of the treated patient can be monitored by conventional methods.

Conditions in general. The compounds of this invention have pharmacological activity resulting from their ability to bind to proteins of interest as agonists, mimetics or antagonists of the native ligands of such proteins of interest. The utility of specific compounds is shown in Table 2. The activity of these compounds can be measured by assays known in the art. For the TPO-mimetic compounds, an in vivo assay is further described in the Examples section herein.

In addition to therapeutic uses, the compounds of the present invention are useful in diagnosing diseases characterized by dysfunction of their associated protein of interest. In one embodiment, a method of detecting in a biological sample a protein of interest (e.g., a receptor) that is capable of being activated comprising the steps of: (a) contacting the sample with a compound of this invention; and (b) detecting activation of the protein of interest by the compound. The biological samples include tissue specimens, intact cells, or extracts thereof. The compounds of this invention may be used as part of a diagnostic kit to detect the presence of their associated proteins of interest in a biological sample. Such kits employ the compounds of the invention having an attached label to allow for detection. The compounds are useful for identifying normal or abnormal proteins of interest. For the EPO-mimetic compounds, for example, presence of abnormal protein of interest in a biological sample may be indicative of such disorders as Diamond Blackfan anemia, where it is believed that the EPO receptor is dysfunctional.

Therapeutic uses of EPO-mimetic compounds. The EPO-mimetic compounds of the invention are useful for treating disorders characterized by low red blood cell levels. Included in the invention are methods of modulating the endogenous activity of an EPO receptor in a mammal, preferably methods of increasing the activity of an EPO receptor. In general, any condition treatable by erythropoietin, such as anemia, may also be treated by the EPO-mimetic compounds of the invention. These compounds are administered by an amount and route of delivery that is appropriate for the nature and severity of the condition being treated and may be ascertained by one skilled in the art. Preferably, administration is by injection, either subcutaneous, intramuscular, or intravenous.

Therapeutic uses of TPO-mimetic compounds. For the TPO-mimetic compounds, one can utilize such standard assays as those described in WO95/26746 entitled "Compositions and Methods for Stimulating Megakaryocyte Growth and Differentiation". In vivo assays also appear in the Examples hereinafter.

The conditions to be treated are generally those that involve an existing megakaryocyte/platelet deficiency or an expected megakaryocyte/platelet deficiency (e.g., because of planned surgery or platelet donation). Such conditions will usually be the result of a deficiency (temporary or permanent) of active Mpl ligand in vivo. The generic term for platelet deficiency is thrombocytopenia, and hence the methods and compositions of the present invention are generally available for treating thrombocytopenia in patients in need thereof.

Thrombocytopenia may be present for various reasons, including chemotherapy and other therapy with a variety of drugs, radiation therapy, surgery, accidental blood loss, and other specific disease conditions. Exemplary specific disease conditions that involve thrombocytopenia and may be treated in accordance with this invention are: aplastic anemia, idiopathic or immune thrombocytopenia (ITP), including idiopathic thrombocytopenic purpura associated with breast cancer; HIV associated ITP and HIV-related thrombotic thrombocytopenic purpura; metastatic tumors which result in thrombocytopenia, systemic lupus erythematosus, including neonatal lupus syndrome, splenomegaly, Fanconi's syndrome, vitamin B12 deficiency, folic acid deficiency, May-Hegglin anomaly, Wiskott-Aldrich syndrome, chronic liver disease; myelodysplastic syndrome associated with thrombocytopenia; paroxysmal nocturnal hemoglobinuria, acute profound thrombocytopenia following C7E3 Fab (Abciximab) therapy; alloimmune thrombocytopenia, including maternal alloimmune thrombocytopenia; thrombocytopenia associated with antiphospholipid antibodies and thrombosis; autoimmune thrombocytopenia; drug-induced immune thrombocytopenia, including carboplatin-induced thrombocytopenia, heparin-induced thrombocytopenia; fetal thrombocytopenia; gestational thrombocytopenia; Hughes' syndrome; lupoid thrombocytopenia; accidental and/or massive blood loss; myeloproliferative disorders; thrombocytopenia in patients with malignancies; thrombotic thrombocytopenia purpura, including thrombotic microangiopathy manifesting as thrombotic thrombocytopenic purpura/hemolytic uremic syndrome in cancer patients; autoimmune hemolytic anemia; occult jejunal diverticulum perforation; pure red cell aplasia; autoimmune thrombocytopenia; nephropathia epidemica; rifampicin-associated acute renal failure; Paris-Trousseau thrombocytopenia; neonatal alloimmune thrombocytopenia; paroxysmal nocturnal hemoglobinuria; hematologic changes in stomach cancer; hemolytic uremic syndromes in childhood; hematologic manifestations related to viral infection including hepatitis A virus and CMV-associated thrombocytopenia. Also, certain treatments for AIDS result in thrombocytopenia (e.g., AZT). Certain wound healing disorders might also benefit from an increase in platelet numbers. Also, certain treatments for AIDS result in thrombocytopenia (e.g., AZT). Certain wound healing disorders might also benefit from an increase in platelet numbers.

The TPO-mimetic compounds of this invention may be used in any situation in which production of platelets or platelet precursor cells is desired, or in which stimulation of the c-Mpl receptor is desired. Thus, for example, the compounds of this invention may be used to treat any condition in a mammal wherein there is a need of platelets, megakaryocytes, and the like. Such conditions are described in detail in the following exemplary sources: WO95/26746; WO95/21919; WO95/18858; WO95/21920 and are incorporated herein.

The TPO-mimetic compounds of this invention may also be useful in maintaining the viability or storage life of platelets and/or megakaryocytes and related cells. Accordingly, it could be useful to include an effective amount of one or more such compounds in a composition containing such cells.

The therapeutic methods, compositions and compounds of the present invention may also be employed, alone or in combination with other cytokines, soluble Mpl receptor, hematopoietic factors, interleukins, growth factors or antibodies in the treatment of disease states characterized by other symptoms as well as platelet deficiencies. It is anticipated that the inventive compound will prove useful in treating some forms of thrombocytopenia in combination with general stimulators of hematopoiesis, such as IL-3 or GM-CSF. Other megakaryocytic stimulatory factors, i.e., meg-CSF, stem cell factor (SCF), leukemia inhibitory factor (LIF), oncostatin M (OSM), or other molecules with megakaryocyte stimulating activity may also be employed with Mpl ligand. Additional exemplary cytokines or hematopoietic factors for such co-administration include IL-1 alpha, IL-1 beta, IL-2, IL-3, IL-4, IL-5, IL-6, IL-11, colony stimulating factor-1 (CSF-1), SCF, GM-CSF, granulocyte colony stimulating factor (G-CSF), EPO, interferon-alpha (IFN-alpha), consensus interferon, IFN-beta, or IFN-gamma. It may further be useful to administer, either simultaneously or sequentially, an effective amount of a soluble mammalian Mpl receptor, which appears to have an effect of causing megakaryocytes to fragment into platelets once the megakaryocytes have reached mature form. Thus, administration of an inventive compound (to enhance the number of mature megakaryocytes) followed by administration of the soluble Mpl receptor (to inactivate the ligand and allow the mature megakaryocytes to produce platelets) is expected to be a particularly effective means of stimulating platelet production. The dosage recited above would be adjusted to compensate for such additional components in the therapeutic composition. Progress of the treated patient can be monitored by conventional methods.

In cases where the inventive compounds are added to compositions of platelets and/or megakaryocytes and related cells, the amount to be included will generally be ascertained experimentally by techniques and assays known in the art. An exemplary range of amounts is 0.1 µg to 1 mg inventive compound per $10^6$ cells.

The conditions to be treated are generally those that involve an existing megakaryocyte/platelet deficiency or an expected megakaryocyte/platelet deficiency (e.g., because of planned surgery or platelet donation). Such conditions will usually be the result of a deficiency (temporary or permanent) of active thrombopoietin in vivo. The generic term for platelet deficiency is thrombocytopenia, and the methods and preparations of the present invention are generally available for treating thrombocytopenia in patients in need thereof.

With regard to anticipated platelet deficiencies, e.g., due to future surgery, a compound of the present invention could be administered several days to several hours prior to the need for platelets. With regard to acute situations, e.g., accidental and massive blood loss, a preparation or composition of the invention is optionally administered along with blood or purified platelets.

The TPO-mimetic compounds of the invention are useful in stimulating certain cell types other than megakaryocytes if such cells are found to express c-Mpl. Conditions associated with such cells that express the c-Mpl, which are responsive to stimulation by a preparation or composition described herein are also within the scope of this invention.

The following examples are not intended to be limiting but only exemplary of specific embodiments of the invention.

Example 1

Expression Construct Assembly

A polynucleotide encoding a TMP fusion protein comprising a murine Fc region (mFc-TMP) was constructed by combining nucleotide sequences individually encoding murine Fc and a TMP (described in EP01124961A2). In the first round of PCR, the murine Fc-encoding component was amplified with PCR primers 3155-58 (SEQ ID NO: 1022) and 1388-00 (SEQ ID NO: 1023).

```
3155-58:
CCGGGTAAAGGTGGAGGTGGTGGTATCGA    (SEQ ID NO: 1024)

3155-59:
CCACCTCCACCTTTACCCGGAGAGTGGGAG   (SEQ ID NO: 1025)
```

In a separate reaction, an TMP-encoding polynucleotide was amplified with primers 1209-85 (SEQ ID NO: 1026) and 3155-59 (SEQ ID NO: 1027).

```
1209-85:
CGTACAGGTTTACGCAAGAAAATGG        (SEQ ID NO: 1028)

1388-00:
CTAGTTATTGCTCAGCGG               (SEQ ID NO: 1029)
```

The resulting PCR fragments were gel purified and combined in a single tube for a second round of PCR with primers 1209-85 (SEQ ID NO: 1030) and 1388-00 (SEQ ID NO: 1031). The PCR product from this second round of amplification was gel purified and digested with restriction enzymes NdeI and XhoI. The digestion fragment was purified and ligated into the vector pAMG21, previously digested with the same enzymes. This ligation mix was transformed via electroporation into the *E. coli* strain Amgen 393 and plated onto LB+Kanamycin media. Colonies were screened via PCR and DNA sequencing. A positive clone with a nucleotide sequence (SEQ ID NO: 1032) encoding the mFc-TMP fusion protein (SEQ ID NO: 1033) was identified and designated 6397.

Murine Fc-TMP fusion protein-encoding polynucleotide (SEQ ID NO: 1034)

```
  1 GATTTGATTC TAGATTTGTT TTAACTAATT AAAGGAGGAA
    TAACAT

Open RF:
    ATGGTCGACGGTTG TAAGCCATGC ATTTGTACAG TCCCAGAAGT
    ATCATCTGTC

101 TTCATCTTCC CCCCAAAGCC CAAGGATGTG CTCACCATTA
    CTCTGACTCC

151 TAAGGTCACG TGTGTTGTGG TAGACATCAG CAAGGATGAT
    CCCGAGGTCC

201 AGTTCAGCTG GTTTGTAGAT GATGTGGAGG TGCACACAGC
    TCAGACGCAA

251 CCCCGGGAGG AGCAGTTCAA CAGCACTTTC CGCTCAGTCA
    GTGAACTTCC

301 CATCATGCAC CAGGACTGGC TCAATGGCAA GGAGTTCAAA
    TGCAGGGTCA

351 ACAGTGCAGC TTTCCCTGCC CCCATCGAGA AAACCATCTC
    CAAAACCAAA

401 GGCAGACCGA AGGCTCCACA GGTGTACACC ATTCCACCTC
    CCAAGGAGCA

451 GATGGCCAAG GATAAAGTCA GTCTGACCTG CATGATAACA
    GACTTCTTCC

501 CTGAAGACAT TACTGTGGAG TGGCAGTGGA ATGGGCAGCC
    AGCGGAGAAC

551 TACAAGAACA CTCAGCCCAT CATGGACACA GATGGCTCTT
    ACTTCGTCTA

601 CAGCAAGCTC AATGTGCAGA AGAGCAACTG GGAGGCAGGA
    AATACTTTCA

651 CCTGCTCTGT GTTACATGAG GGCCTGCACA ACCACCATAC
    TGAGAAGAGC

701 CTCTCCCACT CTCCGGGTAA AGGTGGAGGT GGTGGTATCG
    AAGGTCCGAC

751 TCTGCGTCAG TGGCTGGCTG CTCGTGCTGG TGGTGGAGGT
    GGCGGCGGAG

801 GTATTGAGGG CCCAACCCTT CGCCAATGGC TTGCAGCACG
    CGCATAA

3' Sequence:
    TCTCGAGGATCCG CGGAAAGAAG AAGAAGAAGA AGAAAGCCCG
    AAAGG
```

Murine Fc-TMP protein sequence (SEQ ID NO: 1035)

```
  1 MVDGCKPCIC TVPEVSSVFI FPPKPKDVLT ITLTPKVTCV
    VVDISKDDPE

51 VQFSWFVDDV EVHTAQTQPR EEQFNSTFRS VSELPIMHQD
    WLNGKEFKCR

101 VNSAAFPAPI EKTISKTKGR PKAPQVYTIP PPKEQMAKDK
    VSLTCMITDF

151 FPEDITVEWQ WNGQPAENYK NTQPIMDTDG SYFVYSKLNV
    QKSNWEAGNT

201 FTCSVLHEGL HNHHTEKSLS HSPGKGGGGG IEGPTLRQWL
    AARAGGGGGG

251 GGIEGPTLRQ WLAARA*
```

Example 2

Fermentation of Strain 6397

Fermentation of strain 6397 was initiated by inoculation of 500 mL of sterilized Luria broth with a seed culture of the strain in a shake flask. When cell density reached 0.9 at 600 nm, the contents were used to inoculate a 15 L fermentor containing 10 L of complex based growth medium (800 g glycerol, 500 g trypticase, 3 g sodium citrate, 40 g $KH_2PO_4$, 20 g $(NH_4)_2SO_4$, 5 ml Fluka P-2000 antifoam, 10 ml trace metals (ferric chloride 27.0 g/L, zinc chloride 2.00 g/L, cobalt chloride 2.00 g/L, sodium molybdate 2.00 g/L, calcium chloride 1.00 g/L, cupric sulfate 1.90 g/L, boric acid 0.50 g/L, manganese chloride 1.60 g/L, sodium citrate dihydrate 73.5 g/L), 10 ml vitamins (biotin 0.060 g/L, folic acid 0.040 g/L, riboflavin 0.42 g/L, pyridoxine HCl 1.40 g/L, niacin 6.10 g/L, pantothenic acid 5.40 g/L, sodium hydroxide 5.30 ml/L), add water to bring to 10 L). The fermenter was maintained at 37° C. and pH 7 with dissolved oxygen levels kept at a minimum of 30% saturation. When the cell density reached 13.1 OD units at 600 nm, the culture was induced by the addition 10 ml of 0.5 mg/ml N-(3-oxo-hexanoyl) homoserine lactone. At 6 hours post induction, the broth was chilled to 10° C., and the cells were harvested by centrifugation at 4550 g for 60 min at 5° C. The cell paste was then stored at −80° C.

Example 3

Protein Refolding

E. coli paste (300 g) from strain 6397 expressing mFc-TMP was dissolved in 2250 ml lysis buffer (50 mM Tris HCl, 5 mM EDTA, pH 8.0) and passed through a chilled microfluidizer two times at 13,000 PSI. The homogenate was then centrifuged at 11,300 g for 60 minutes at 4° C. The supernatant was discarded, and the pellet was resuspended in 2400 ml of water using a tissue grinder. The homogenate was then centrifuged at 11,300 g for 60 minutes at 4° C. The supernatant was discarded, and the pellet was resuspended in 200 ml volumes of water using a tissue grinder. The homogenate was centrifuged at 27,200 g for 30 minutes at 4° C., and the supernatant was discarded. About 12.5% of the pellet was resuspended in 28 ml 20 mM Tris HCl, pH 8.0, with 35 mg hen egg white lysozyme (Sigma, St Louis, Mo.) using a tissue grinder and incubated at 37° C. for 20 min. Following incubation, the suspension was centrifuged at 27,200 g for 30 minutes at 22° C., and the supernatant was discarded. The pellet was resuspended in 35 ml 8 M guanidine HCl, 50 mM Tris HCl, pH 8.0, after which 350 µl 1 M DTT (Sigma, St Louis, Mo.) was added and material was incubated at 37° C. for 30 minutes. The solution was then centrifuged at 27,200 g for 30 minutes at 22° C. The supernatant was then transferred to 3.5 L of refolding buffer (50 mM Tris base, 160 mM arginine HCl, 3 M urea, 20% glycerol, pH 9.5, 1 mM cysteine, 1 mM cystamine HCl) at 1 ml/min with gentle stirring at 4° C.

Example 4

Construct Purification

After about 40 hours incubation at 4° C. with gentle agitation, the refold solution described in Example 3 was concentrated to 500 µl using a tangential flow ultrafiltration apparatus with a 30 kDa cartridge (Satorius, Goettingen, Germany) followed by diafiltration against 3 L of Q-Buffer A (20 mM Tris HCl, pH 8.0). The concentrated material was filtered through a Whatman GF/A filter and loaded on to an 86 ml Q-Sepharose fast flow column (2.6 cm ID) (Amersham Biosciences, Piscataway, N.J.) at 15 ml/min. After washing the resin with several column volumes of Q-Buffer A, the protein was eluted using a 20 column volume linear gradient to 60% Q-Buffer B (20 mM Tris HCl, 1 M NaCl, pH 8.0) at 10 ml/min. The peak fractions were pooled, and the pool was passed through a Mustang E syringe filter (Pall Corporation, East Hills, N.Y.) at 1 ml/min. The filtered material was filtered a second time through a 0.22 µm cellulose acetate filter and stored at −80° C.

Example 5

Protein PEGylation

To a cooled (4° C.), stirred solution of mFc-TMP (3.5 ml, 0.8 mg/ml) in a 100 mM sodium acetate buffer, pH 5, containing 20 mM NaCNBH$_3$, was added a 3.8-fold molar excess of methoxypolyethylene glycol aldehyde (MPEG) (average molecular weight, 20 kDa) (Nektar). The stirring of the reaction mixture was continued at the same temperature. The extent of the protein modification during the course of the reaction was monitored by SEC HPLC using a Superose 6 HR 10/30 column (Amersham Biosciences) eluted with a 0.05 M phosphate buffer with 0.15 M NaCl, pH 7.0 at 0.4 ml/min. After 16 hours the SEC HPLC analysis indicated that the majority of the protein has been conjugated to MPEG. At this time the reaction mixture was buffer-exchanged into a 20 mM Tris/HCl buffer, pH 8.12. The MPEG-mFc-AMP2 conjugates were isolated by ion exchange chromatography using a 1 ml Hi Trap HP Q column (Amersham Biosciences) equilibrated with a 20 mM Tris/HCl buffer, pH 8.12. The reaction mixture was loaded on the column at a flow rate of 0.5 ml/min and the unreacted MPEG aldehyde was eluted with three column volumes of the starting buffer. A linear 20-column-volume gradient from 0% to 100% 20 mM Tris/HCl buffer, pH 8.12, containing 0.5 M NaCl was used to the elute the protein-polymer conjugates. Fractions (2 ml) collected during ion exchange chromatography separation were analyzed by HPLC SEC as described above. A fraction containing the mono- and di-MPEG-mFc-TMP conjugates in an approximate ratio of 2.3 to 1 (as determined by SEC HPLC) was concentrated, and sterile filtered.

Example 6

In Vivo Testing

BDF1 mice (Charles River Laboratories, Wilmington, Mass.) were divided into groups of 10 and injected on days 0, 21, and 42 subcutaneously with either diluting agent (Dulbecco's PBS with 0.1% bovine serum albumin) or diluting agent with 50 µg test mono- and di-MPEG-mFc-TMP conjugate protein (as described above) per kg animal. Each group was divided in half and bled (140 µl) from the retro-orbital sinus on alternate time points (days 0, 3, 5, 7, 10, 12, 14, 19, 24, 26, 28, 31, 33, 40, 45, 47, 49, 52 and 59). On day 59, mice were anesthetized with isoflurane prior to bleeding. The collected blood was analyzed for a complete and differential count using an ADVIA 120 automated blood analyzer with murine software (Bayer Diagnostics, New York, N.Y.).

Results showed that administration of mono- and di-MPEG-mFc-TMP conjugates on days 0, 21 and 41 resulted in subsequent increases in platelet levels to essentially the same degree with each dose. See FIG. 1. In comparison, administration of mFc-TMP (lacking a PEG moiety) on the same days (i.e., days 0, 21 and 41) also resulted in increased levels of platelets, but the increase following administration on day 21 was significantly lower (i.e., attenuated) than the increase after administration on day 0, and the increase following administration on day 41 was less (i.e., further attenuated) than that observed following administration on day 21. Overall, these results indicate that the Fc-TMP modified to include a WSP (e.g., PEG) moiety was able to induce platelet production that did not decrease when administered in a multiple dosage regimen.

The present invention has been described in terms of particular embodiments found or proposed to comprise preferred modes for the practice of then invention. It will be appreciated by those of ordinary skill in the art that, in light of the present disclosure, numerous modifications and changes can be made in the particular embodiments exemplified without departing from the intended scope of the invention.

SEQUENCE LISTING (1696 sequences)

SEQ ID NO: 1 - protein, 41 aa, Artificial sequence
  Synthetic peptide
  Binding (1)..(1): Fc-WSP bound to Gly in position 1
GGGGGIEGPTLRQWLAARAGGGGGGGGIEGPTLRQWLAARA

SEQ ID NO: 2 - protein, 41 aa, Artificial sequence; identical to SEQ ID NO: 1
  Synthetic peptide
  Binding (1)..(1): Fc-PEG bound to Gly in position 1

SEQ ID NO: 3 - protein, 9 aa, Artificial sequence
  Synthetic peptide
  Misc_feature (1)..(1): Xaa=Val, Leu, Ile, Glu, Pro, Gly, Tyr, Met, Thr, or Asp
  Misc_feature (2)..(2): Xaa=Tyr, Trp, or Phe
  Misc_feature (3)..(3): Xaa=Glu, Phe, Val, Trp, or Tyr
  Misc_feature (4)..(5): If residue 5 is not Pro, azetidine is between residues 4 and 5
  Misc_feature (5)..(5): Xaa=Pro or nothing
  Misc_feature (7)..(7): Xaa=Ser, Ala, Val, or Leu
  Misc_feature (8)..(8): Xaa=Met, Phe, Val, Arg, Gln, Lys, Thr, Ser, Asp, Leu, Ile, or Glu
  Misc_feature (9)..(9): Xaa=Glu, Leu, Trp, Val, His, Ile, Gly, Ala, Asp, Leu, Tyr, Asn, Gln, or Pro
XXXQXYXXX

SEQ ID NO: 4 - protein, 8 aa, Artificial sequence
  Synthetic peptide
  Misc_feature (1)..(2): Xaa=any amino acid
  Misc_feature (3)..(4): If residue 4 is not Pro, Azetidine is between residues 3 and 4
  Misc_feature (4)..(4): Xaa=Pro or nothing
  Misc_feature (6)..(6): Xaa=Ser, Ala, Val, or Leu
  Misc_feature (7)..(8): Xaa=any amino acid
XXQXYXXX

SEQ ID NO: 5 - protein, 8 aa, Artificial sequence
  Synthetic peptide
  Misc_feature (1)..(1): Xaa=Tyr, Trp, or Phe
  Misc_feature (2)..(2): Xaa=any amino acid
  Misc_feature (3)..(4): If residue 4 is not Pro, Azetidine is between residues 3 and 4
  Misc_feature (4)..(4): Xaa=Pro or nothing
  Misc_feature (6)..(6): Xaa=Ser, Ala, Val, or Leu
  Misc_feature (7)..(8): Xaa=any amino acid
XXQXYXXX

SEQ ID NO: 6 - protein, 8 aa, Artificial sequence
  Synthetic peptide
  Misc_feature (1)..(1): Xaa=Tyr, Trp, or Phe
  Misc_feature (2)..(2): Xaa=Glu, Phe, Val, Trp, or Tyr
  Misc_feature (3)..(4): If residue 4 is not Pro, Azetidine is between residues 3 and 4
  Misc_feature (4)..(4): Xaa=Pro or nothing
  Misc_feature (6)..(6): Xaa=Ser, Ala, Val, or Leu
  Misc_feature (7)..(7): Xaa=Met, Phe, Val, Arg, Gln, Lys, Thr, Ser, Asp, Leu, Ile, or Glu
  Misc_feature (8)..(8): Xaa=Glu, Leu, Trp, Val, His, Ile, Gly, Ala, Asp, Leu, Tyr, Asn, Gln, or Pro
XXQXYXXX

SEQ ID NO: 7 - protein, 9 aa, Artificial sequence
  Synthetic peptide
  Misc_feature (1)..(1): Xaa=Val, Leu, Ile, Glu, Pro, Gly, Tyr, Met, Thr, or Asp
  Misc_feature (2)..(2): Xaa=Tyr, Trp, or Phe
  Misc_feature (3)..(3): Xaa=Glu, Phe, Val, Trp, or Tyr
  Misc_feature (4)..(5): If residue 5 is not Pro, azetidine is between residues 4 and 5
  Misc_feature (5)..(5): Xaa=Pro or nothing
  Misc_feature (7)..(7): Xaa=Ser, Ala, Val, or Leu
  Misc_feature (8)..(8): Xaa=Met, Phe, Val, Arg, Gln, Lys, Thr, Ser, Asp, Leu, Ile, or Glu
  Misc_feature (9)..(9): Xaa=Glu, Leu, Trp, Val, His, Ile, Gly, Ala, Asp, Leu, Tyr, Asn, Gln, or Pro
XXXQXYXXX

SEQ ID NO: 8 - protein, 21 aa, Artificial sequence
  Synthetic peptide
  Misc_feature (1)..(1): Xaa=Ala, Asp, Glu, Phe, Gly, Lys, Gln, Ser, Thr, or Tyr
  Misc_feature (2)..(2): Xaa=Ala, Asp, Gly, Ile, Asn, Pro, Ser, Thr, Val, or Trp
  Misc_feature (3)..(3): Xaa=Ala, Asp, Gly, Leu, Asn, Pro, Ser, Thr, Trp, or Tyr
  Misc_feature (4)..(4): Xaa=Ala, Asp, Glu, Phe, Leu, Asn, Arg, Val, or Tyr
  Misc_feature (5)..(5): Xaa=Ala, Asp, Glu, Gln, Arg, Ser, or Thr
  Misc_feature (6)..(6): Xaa=His, Ile, Leu, Pro, Ser, Thr, or Trp
  Misc_feature (7)..(7): Xaa=Ala, Glu, Phe, Lys, Asn, Gln, Arg, Ser, or Tyr
  Misc_feature (8)..(8): Xaa=Asp, Glu, Phe, Gln, Arg, Thr, or Trp
  Misc_feature (9)..(9): Xaa=Ala, Asp, Pro, Ser, Thr, or Trp
  Misc_feature (10)..(10): Xaa=Ala, Asp, Gly, Lys, Asn, Gln, Ser, or Thr
  Misc_feature (11)..(11): Xaa=Ala, Glu, Leu, Pro, Ser, Thr, Val, or Tyr
  Misc_feature (12)..(12): Xaa=Val, Leu, Ile, Glu, Pro, Gly, Tyr, Met, Thr, or Asp
  Misc_feature (13)..(13): Xaa=Tyr, Trp, or Phe
  Misc_feature (14)..(14): Xaa=Glu, Phe, Val, Trp, or Tyr
  Misc_feature (15)..(16): if Pro is not residue 16, azetidine is between residues 15 and 16
  Misc_feature (16)..(16): Xaa=Pro or nothing
  Misc_feature (18)..(18): Xaa=Ser, Ala, Val, or Leu
  Misc_feature (19)..(19): Xaa=Met, Phe, Val, Arg, Gln, Lys, Thr, Ser, Asp, Leu, Ile, or Glu
  Misc_feature (20)..(20): Xaa=Glu, Leu, Trp, Val, His, Ile, Gly, Ala, Asp, Leu, Tyr, Asn, Gln, or Pro
XXXXXXXXXXXXXXQXYXXXL

SEQ ID NO: 9 - protein, 11 aa, Artificial sequence
  Synthetic peptide
  Misc_feature (1)..(1): Xaa=Asp or Tyr
  Misc_feature (3)..(3): Xaa=Asp, Ser, or Thr
  Misc_feature (4)..(4): Xaa=Ser, Thr, or Ala
  Misc_feature (5)..(5): Xaa=Ser or Trp
  Misc_feature (6)..(6): Xaa=Ser or Tyr
  Misc_feature (7)..(7): Xaa=Asp, Gln, Glu, or Val
  Misc_feature (8)..(8): Xaa=Asn, Ser, Lys, His, or Trp
  Misc_feature (9)..(9): Xaa=Phe or Leu
  Misc_feature (10)..(10): Xaa=Asp, Asn, Ser, or Leu
  Misc_feature (11)..(11): Xaa=Leu, Ile, Gln, Met, or Ala
XNXXXXXXXXX

SEQ ID NO: 10 - protein, 21 aa, Artificial sequence
  Synthetic peptide
TANVSSFEWTPYYWQPYALPL

SEQ ID NO: 11 - protein, 18 aa, Artificial sequence
  Synthetic peptide
SWTDYGYWQPYALPISGL

SEQ ID NO: 12 - protein, 21 aa, Artificial sequence
  Synthetic peptide
ETPFTWEESNAYYWQPYALPL

SEQ ID NO: 13 - protein, 21 aa, Artificial sequence
  Synthetic peptide
ENTYSPNWADSMYWQPYALPL

SEQ ID NO: 14 - protein, 21 aa, Artificial sequence
  Synthetic peptide
SVGEDHNFWTSEYWQPYALPL

SEQ ID NO: 15 - protein, 21 aa, Artificial sequence
  Synthetic peptide
DGYDRWRQSGERYWQPYALPL

SEQ ID NO: 16 - protein, 11 aa, Artificial sequence
  Synthetic peptide
FEWTPGYWQPY

SEQ ID NO: 17 - protein, 11 aa, Artificial sequence
  Synthetic peptide
FEWTPGYWQHY

SEQ ID NO: 18 - protein, 10 aa, Artificial sequence
  Synthetic peptide
  Misc_feature (9)..(10): Azetidine is between residues 9 and 10
FEWTPGWYQY

SEQ ID NO: 19 - protein, 10 aa, Artificial sequence
  Synthetic peptide
  Acetylation (1)..(1): Acetylated phenylalanine at position 1
  Misc_feature (9)..(10): Azetidine is between residues 9 and 10
FEWTPGWYQY

SEQ ID NO: 20 - protein, 10 aa, Artificial sequence
  Synthetic peptide
  Phosphorylation (8)..(8): Phosphorylated tyrosine at position 8
  Misc_feature (9)..(10): Azetidine is between residues 9 and 10
FEWTPGWYQY

SEQ ID NO: 21 - protein, 10 aa, Artificial sequence
  Synthetic peptide
  Misc_feature (9)..(10): Azetidine is between residues 9 and 10
FAWTPGYWQY

SEQ ID NO: 22 - protein, 10 aa, Artificial sequence
  Synthetic peptide
  Misc_feature (9)..(10): Azetidine is between residues 9 and 10
FEWAPGYWQY

SEQ ID NO: 23 - protein, 10 aa, Artificial sequence
  Synthetic peptide
  Misc_feature (9)..(10): Azetidine is between residues 9 and 10
FEWVPGYWQY

SEQ ID NO: 24 - protein, 10 aa, Artificial sequence
  Synthetic peptide
  Misc_feature (9)..(10): Azetidine is between residues 9 and 10
FEWTPGYWQY

SEQ ID NO: 25 - protein, 10 aa, Artificial sequence
  Synthetic peptide
  Acetylation (1)..(1): Acetylated phenylalanine at position 1
  Misc_feature (9)..(10): Azetidine is between residues 9 and 10
FEWTPGYWQY

SEQ ID NO: 26 - protein, 10 aa, Artificial sequence
  Synthetic peptide
  Misc_feature (9)..(10): Azetidine is between residues 9 and 10
FEWTPAWYQY

SEQ ID NO: 27 - protein, 10 aa, Artificial sequence
  Synthetic peptide
  Misc_feature (6)..(6): Xaa=Sarcosine
  Misc_feature (9)..(10): Azetidine is between residues 9 and 10
FEWTPXWYQY

SEQ ID NO: 28 - protein, 11 aa, Artificial sequence
  Synthetic peptide
FEWTPGYYQPY

SEQ ID NO: 29 - protein, 11 aa, Artificial sequence
  Synthetic peptide
FEWTPGWWQPY

SEQ ID NO: 30 - protein, 11 aa, Artificial sequence
  Synthetic peptide
FEWTPNYWQPY

SEQ ID NO: 31 - protein, 10 aa, Artificial sequence
  Synthetic peptide
  misc_feature (9)..(10): Azetidine is between residues 9 and 10
FEWTPVYWQY

SEQ ID NO: 32 - protein, 9 aa, Artificial sequence
  Synthetic peptide
  Misc_feature (4)..(5): Pipecolic acid is between residues 4 and 5
  Misc_feature (8)..(9): Azetidine is between residues 8 and 9
FEWTGYWQY

SEQ ID NO: 33 - protein, 9 aa, Artificial sequence
  Synthetic peptide
  Misc_feature (5)..(6): Aminoisobutyric acid is between residues 5 and 6
  Misc_feature (8)..(9): Azetidine is between residues 8 and 9
FEWTPYWQY

SEQ ID NO: 34 - protein, 10 aa, Artificial sequence
  Synthetic peptide
  Misc_feature (5)..(5): Xaa=Sarcosine
  Misc_feature (9)..(10): Azetidine is between residues 9 and 10
FEWTXGYWQY

SEQ ID NO: 35 - protein, 11 aa, Artificial sequence
  Synthetic peptide
FEWTPGYWQPY

SEQ ID NO: 36 - protein, 11 aa, Artificial sequence
  Synthetic peptide
FEWTPGYWQHY

SEQ ID NO: 37 - protein, 10 aa, Artificial sequence
  Synthetic peptide
  Misc_feature (9)..(10): Azetidine is between residues 9 and 10
FEWTPGWYQY

SEQ ID NO: 38 - protein, 10 aa, Artificial sequence
  Synthetic peptide
  Acetylation (1)..(1): Acetylated phenylalanine at position 1
  Misc_feature (9)..(10): Azetidine is between residues 9 and 10
FEWTPGWYQY

SEQ ID NO: 39 - protein, 10 aa, Artificial sequence
  Synthetic peptide
  Phosphorylation (8)..(8): Phosphorylated Tyr at position 8
  Misc_feature (9)..(10): Azetidine is between residues 9 and 10
FEWTPGWYQY

SEQ ID NO: 40 - protein, 10 aa, Artificial sequence
  Synthetic peptide
  Misc_feature (9)..(10): Azetidine is between residues 9 and 10
FAWTPGYWQY

SEQ ID NO: 41 - protein, 10 aa, Artificial sequence
  Synthetic peptide
  Misc_feature (9)..(10): Azetidine is between residues 9 and 10
FEWAPGYWQY

SEQ ID NO: 42 - protein, 10 aa, Artificial sequence
  Synthetic peptide
  Misc_feature (9)..(10): Azetidine is between residues 9 and 10
FEWVPGYWQY

SEQ ID NO: 43 - protein, 10 aa, Artificial sequence
  Synthetic peptide
  Misc_feature (9)..(10): Azetidine is between residues 9 and 10
FEWTPGYWQY

SEQ ID NO: 44 - protein, 10 aa, Artificial sequence
  Synthetic peptide
  Acetylation (1)..(1): Acetylated phenylalanine at position 1
  Misc_feature (9)..(10): Azetidine is between residues 9 and 10
FEWTPGYWQY

SEQ ID NO: 45 - protein, 10 aa, Artificial sequence
  Synthetic peptide
  Misc_feature (6)..(6): D-Ala
  Misc_feature (9)..(10): Azetidine is between residues 9 and 10
FEWTPAWYQY

SEQ ID NO: 46 - protein, 10 aa, Artificial sequence
  Synthetic peptide
  Misc_feature (6)..(6): Xaa=Sarcosine
  Misc_feature (9)..(10): Azetidine is between residues 9 and 10
FEWTPXWYQY

SEQ ID NO: 47 - protein, 11 aa, Artificial sequence
  Synthetic peptide
FEWTPGYYQPY

SEQ ID NO: 48 - protein, 11 aa, Artificial sequence
  Synthetic peptide
FEWTPGWWQPY

SEQ ID NO: 49 - protein, 11 aa, Artificial sequence
  Synthetic peptide
FEWTPNYWQPY

SEQ ID NO: 50 - protein, 10 aa, Artificial sequence
  Synthetic peptide
  Misc_feature (6)..(6): D-Val
  Misc_feature (9)..(10): Azetidine is between residues 9 and 10
FEWTPVYWQY

SEQ ID NO: 51 - protein, 9 aa, Artificial sequence
  Synthetic peptide
  Misc_feature (4)..(5): Pipecolic acid is between residues 4 and 5
  Misc_feature (8)..(9): Azetidine is between residues 8 and 9
FEWTGYWQY

SEQ ID NO: 52 - protein, 9 aa, Artificial sequence
  Synthetic peptide
  Misc_feature (5)..(6): Aminoisobutyric acid is between residues 5 and 6
  Misc_feature (8)..(9): Azetidine is between residues 8 and 9
FEWTPYWQY

SEQ ID NO: 53 - protein, 10 aa, Artificial sequence
  Synthetic peptide
  Misc_feature (5)..(5): Xaa=Sarcosine
  Misc_feature (9)..(10): Azetidine is between residues 9 and 10
FEWTXGYWQY

SEQ ID NO: 54 - protein, 15 aa, Artificial sequence
  Synthetic peptide
FEWTPGYWQPYALPL

SEQ ID NO: 55 - protein, 10 aa, Artificial sequence
  Synthetic peptide
  Misc_feature (1)..(1): Ala modified to 1-naphthylalanine at position 1
  (9)..(10): Azetidine is between residues 9 and 10
AEWTPGYYQY

SEQ ID NO: 56 - protein, 10 aa, Artificial sequence
  Synthetic peptide
  Misc_feature (9)..(10): Azetidine is between residues 9 and 10
YEWTPGYYQY

SEQ ID NO: 57 - protein, 10 aa, Artificial sequence
  Synthetic peptide
  Misc_feature (9)..(10): Azetidine is between residues 9 and 10
FEWVPGYYQY

SEQ ID NO: 58 - protein, 10 aa, Artificial sequence
  Synthetic peptide
  Misc_feature (6)..(6): D-Ser
  Misc_feature (9)..(10): Azetidine is between residues 9 and 10
FEWTPSYYQY

SEQ ID NO: 59 - protein, 10 aa, Artificial sequence
  Synthetic peptide
  Misc_feature (6)..(6): D-Asn
  Misc_feature (9)..(10): Azetidine is between residues 9 and 10
FEWTPNYYQY

SEQ ID NO: 60 - protein, 4 aa, Artificial sequence
  Synthetic peptide
TKPR

SEQ ID NO: 61 - protein, 5 aa, Artificial sequence
  Synthetic peptide
RKSSK

SEQ ID NO: 62 - protein, 5 aa, Artificial sequence
  Synthetic peptide
RKQDK

SEQ ID NO: 63 - protein, 6 aa, Artificial sequence
  Synthetic peptide
NRKQDK

SEQ ID NO: 64 - protein, 6 aa, Artificial sequence
  Synthetic peptide
RKQDKR

SEQ ID NO: 65 - protein, 9 aa, Artificial sequence
  Synthetic peptide
ENRKQDKRF

SEQ ID NO: 66 - protein, 6 aa, Artificial sequence
  Synthetic peptide
VTKFYF

SEQ ID NO: 67 - protein, 5 aa, Artificial sequence
  Synthetic peptide
VTKFY

SEQ ID NO: 68 - protein, 5 aa, Artificial sequence
  Synthetic peptide
VTDFY

SEQ ID NO: 69 - protein, 11 aa, Artificial sequence
  Synthetic peptide
SHLYWQPYSVQ

SEQ ID NO: 70 - protein, 12 aa, Artificial sequence
  Synthetic peptide
TLVYWQPYSLQT

SEQ ID NO: 71 - protein, 12 aa, Artificial sequence
  Synthetic peptide
RGDYWQPYSVQS

SEQ ID NO: 72 - protein, 12 aa, Artificial sequence
  Synthetic peptide
VHVYWQPYSVQT

SEQ ID NO: 73 - protein, 12 aa, Artificial sequence
  Synthetic peptide
RLVYWQPYSVQT

SEQ ID NO: 74 - protein, 12 aa, Artificial sequence
  Synthetic peptide
SRVWFQPYSLQS

SEQ ID NO: 75 - protein, 12 aa, Artificial sequence
  Synthetic peptide
NMVYWQPYSIQT

SEQ ID NO: 76 - protein, 12 aa, Artificial sequence
  Synthetic peptide
SVVFWQPYSVQT

SEQ ID NO: 77 - protein, 12 aa, Artificial sequence
  Synthetic peptide
TFVYWQPYALPL

SEQ ID NO: 78 - protein, 12 aa, Artificial sequence
  Synthetic peptide
TLVYWQPYSIQR

SEQ ID NO: 79 - protein, 12 aa, Artificial sequence
  Synthetic peptide
RLVYWQPYSVQR

SEQ ID NO: 80 - protein, 12 aa, Artificial sequence
  Synthetic peptide
SPVFWQPYSIQI

SEQ ID NO: 81 - protein, 12 aa, Artificial sequence
  Synthetic peptide
WIEWWQPYSVQS

SEQ ID NO: 82 - protein, 12 aa, Artificial sequence
  Synthetic peptide
SLIYWQPYSLQM

SEQ ID NO: 83 - protein, 12 aa, Artificial sequence
  Synthetic peptide
TRLYWQPYSVQR

SEQ ID NO: 84 - protein, 12 aa, Artificial sequence
  Synthetic peptide
RCDYWQPYSVQT

SEQ ID NO: 85 - protein, 12 aa, Artificial sequence
  Synthetic peptide
MRVFWQPYSVQN

SEQ ID NO: 86 - protein, 12 aa, Artificial sequence
  Synthetic peptide
KIVYWQPYSVQT

SEQ ID NO: 87 - protein, 12 aa, Artificial sequence
  Synthetic peptide
RHLYWQPYSVQR

SEQ ID NO: 88 - protein, 12 aa, Artificial sequence
  Synthetic peptide
ALVWWQPYSEQI

SEQ ID NO: 89 - protein, 12 aa, Artificial sequence
  Synthetic peptide
SRVWFQPYSLQS

SEQ ID NO: 90 - protein, 10 aa, Artificial sequence
  Synthetic peptide
WEQPYALPLE

SEQ ID NO: 91 - protein, 12 aa, Artificial sequence
  Synthetic peptide
QLVWWQPYSVQR

SEQ ID NO: 92 - protein, 12 aa, Artificial sequence
  Synthetic peptide
DLRYWQPYSVQV

SEQ ID NO: 93 - protein, 12 aa, Artificial sequence
  Synthetic peptide
ELVWWQPYSLQL

SEQ ID NO: 94 - protein, 12 aa, Artificial sequence
  Synthetic peptide
DLVWWQPYSVQW

SEQ ID NO: 95 - protein, 12 aa, Artificial sequence
  Synthetic peptide
NGNYWQPYSFQV

SEQ ID NO: 96 - protein, 12 aa, Artificial sequence
  Synthetic peptide
ELVYWQPYSIQR

SEQ ID NO: 97 - protein, 12 aa, Artificial sequence
  Synthetic peptide
ELMYWQPYSVQE

SEQ ID NO: 98 - protein, 12 aa, Artificial sequence
  Synthetic peptide
NLLYWQPYSMQD

SEQ ID NO: 99 - protein, 12 aa, Artificial sequence
  Synthetic peptide
GYEWYQPYSVQR

SEQ ID NO: 100 - protein, 12 aa, Artificial sequence
  Synthetic peptide
SRVWYQPYSVQR

SEQ ID NO: 101 - protein, 12 aa, Artificial sequence
  Synthetic peptide
LSEQYQPYSVQR

SEQ ID NO: 102 - protein, 12 aa, Artificial sequence
  Synthetic peptide
GGGWWQPYSVQR

SEQ ID NO: 103 - protein, 12 aa, Artificial sequence
  Synthetic peptide
VGRWYQPYSVQR

SEQ ID NO: 104 - protein, 12 aa, Artificial sequence
  Synthetic peptide
VHVYWQPYSVQR

SEQ ID NO: 105 - protein, 12 aa, Artificial sequence
  Synthetic peptide
QARWYQPYSVQR

SEQ ID NO: 106 - protein, 12 aa, Artificial sequence
  Synthetic peptide
VHVYWQPYSVQT

SEQ ID NO: 107 - protein, 12 aa, Artificial sequence
  Synthetic peptide
RSVYWQPYSVQR

SEQ ID NO: 108 - protein, 12 aa, Artificial sequence
  Synthetic peptide
TRVWFQPYSVQR

SEQ ID NO: 109 - protein, 12 aa, Artificial sequence
  Synthetic peptide
GRIWFQPYSVQR

SEQ ID NO: 110 - protein, 12 aa, Artificial sequence
  Synthetic peptide
GRVWFQPYSVQR

SEQ ID NO: 111 - protein, 12 aa, Artificial sequence
  Synthetic peptide
ARTWYQPYSVQR

SEQ ID NO: 112 - protein, 12 aa, Artificial sequence
  Synthetic peptide
ARVWWQPYSVQM

SEQ ID NO: 113 - protein, 12 aa, Artificial sequence
  Synthetic peptide
RLMFYQPYSVQR

SEQ ID NO: 114 - protein, 12 aa, Artificial sequence
  Synthetic peptide
ESMWYQPYSVQR

SEQ ID NO: 115 - protein, 12 aa, Artificial sequence
  Synthetic peptide
HFGWWQPYSVHM

SEQ ID NO: 116 - protein, 12 aa, Artificial sequence
  Synthetic peptide
ARFWWQPYSVQR

SEQ ID NO: 117 - protein, 12 aa, Artificial sequence
  Synthetic peptide
RLVYWQPYAPIY

SEQ ID NO: 118 - protein, 12 aa, Artificial sequence
  Synthetic peptide
RLVYWQPYSYQT

SEQ ID NO: 119 - protein, 12 aa, Artificial sequence
  Synthetic peptide
RLVYWQPYSLPI

SEQ ID NO: 120 - protein, 12 aa, Artificial sequence
  Synthetic peptide
RLVYWQPYSVQA

SEQ ID NO: 121 - protein, 12 aa, Artificial sequence
  Synthetic peptide
SRVWYQPYAKGL

SEQ ID NO: 122 - protein, 12 aa, Artificial sequence
  Synthetic peptide
SRVWYQPYAQGL

SEQ ID NO: 123 - protein, 12 aa, Artificial sequence
  Synthetic peptide
SRVWYQPYAMPL

SEQ ID NO: 124 - protein, 12 aa, Artificial sequence
  Synthetic peptide
SRVWYQPYSVQA

SEQ ID NO: 125 - protein, 12 aa, Artificial sequence
  Synthetic peptide
SRVWYQPYSLGL

SEQ ID NO: 126 - protein, 12 aa, Artificial sequence
  Synthetic peptide
SRVWYQPYAREL

SEQ ID NO: 127 - protein, 12 aa, Artificial sequence
  Synthetic peptide
SRVWYQPYSRQP

SEQ ID NO: 128 - protein, 12 aa, Artificial sequence
  Synthetic peptide
SRVWYQPYFVQP

SEQ ID NO: 129 - protein, 12 aa, Artificial sequence
  Synthetic peptide
EYEWYQPYALPL

SEQ ID NO: 130 - protein, 12 aa, Artificial sequence
  Synthetic peptide
IPEYWQPYALPL

SEQ ID NO: 131 - protein, 12 aa, Artificial sequence
  Synthetic peptide
SRIWWQPYALPL

SEQ ID NO: 132 - protein, 12 aa, Artificial sequence
  Synthetic peptide
DPLFWQPYALPL

SEQ ID NO: 133 - protein, 12 aa, Artificial sequence
  Synthetic peptide
SRQWVQPYALPL

SEQ ID NO: 134 - protein, 12 aa, Artificial sequence
  Synthetic peptide
IRSWWQPYALPL

SEQ ID NO: 135 - protein, 11 aa, Artificial sequence
  Synthetic peptide
RGYWQPYALPL

SEQ ID NO: 136 - protein, 12 aa, Artificial sequence
  Synthetic peptide
RLLWVQPYALPL

SEQ ID NO: 137 - protein, 12 aa, Artificial sequence
  Synthetic peptide
EYRWFQPYALPL

SEQ ID NO: 138 - protein, 12 aa, Artificial sequence
  Synthetic peptide
DAYWVQPYALPL

SEQ ID NO: 139 - protein, 12 aa, Artificial sequence
  Synthetic peptide
WSGYFQPYALPL

SEQ ID NO: 140 - protein, 12 aa, Artificial sequence
  Synthetic peptide
NIEFWQPYALPL

SEQ ID NO: 141 - protein, 12 aa, Artificial sequence
  Synthetic peptide
TRDWVQPYALPL

SEQ ID NO: 142 - protein, 12 aa, Artificial sequence
  Synthetic peptide
DSSWYQPYALPL

SEQ ID NO: 143 - protein, 12 aa, Artificial sequence
  Synthetic peptide
IGNWYQPYALPL

SEQ ID NO: 144 - protein, 12 aa, Artificial sequence
  Synthetic peptide
NLRWDQPYALPL

SEQ ID NO: 145 - protein, 12 aa, Artificial sequence
  Synthetic peptide
LPEFWQPYALPL

SEQ ID NO: 146 - protein, 12 aa, Artificial sequence
  Synthetic peptide
DSYWWQPYALPL

SEQ ID NO: 147 - protein, 12 aa, Artificial sequence
  Synthetic peptide
RSQYYQPYALPL

SEQ ID NO: 148 - protein, 12 aa, Artificial sequence
  Synthetic peptide
ARFWLQPYALPL

SEQ ID NO: 149 - protein, 12 aa, Artificial sequence
  Synthetic peptide
NSYFWQPYALPL

SEQ ID NO: 150 - protein, 12 aa, Artificial sequence
  Synthetic peptide
RFMYWQPYSVQR

SEQ ID NO: 151 - protein, 12 aa, Artificial sequence
  Synthetic peptide
AHLFWQPYSVQR

SEQ ID NO: 152 - protein, 9 aa, Artificial sequence
  Synthetic peptide
WWQPYALPL

SEQ ID NO: 153 - protein, 9 aa, Artificial sequence
  Synthetic peptide
YYQPYALPL

SEQ ID NO: 154 - protein, 9 aa, Artificial sequence
  Synthetic peptide
YFQPYALGL

SEQ ID NO: 155 - protein, 10 aa, Artificial sequence
  Synthetic peptide
YWYQPYALPL

SEQ ID NO: 156 - protein, 10 aa, Artificial sequence
  Synthetic peptide
RWWQPYATPL

SEQ ID NO: 157 - protein, 10 aa, Artificial sequence
  Synthetic peptide
GWYQPYALGF

SEQ ID NO: 158 - protein, 10 aa, Artificial sequence
  Synthetic peptide
YWYQPYALGL

SEQ ID NO: 159 - protein, 10 aa, Artificial sequence
  Synthetic peptide
IWYQPYAMPL

SEQ ID NO: 160 - protein, 10 aa, Artificial sequence
  Synthetic peptide
SNMQPYQRLS

SEQ ID NO: 161 - protein, 20 aa, Artificial sequence
  Synthetic peptide
TFVYWQPYAVGLPAAETACN

SEQ ID NO: 162 - protein, 20 aa, Artificial sequence
  Synthetic peptide
TFVYWQPYSVQMTITGKVTM

SEQ ID NO: 163 - protein, 20 aa, Artificial sequence
  Synthetic peptide
  Misc_feature (12)..(13): Xaa=any amino acid
  Misc_feature (16)..(16): Xaa=any amino acid
TFVYWQPYSSHXXVPXGFPL

SEQ ID NO: 164 - protein, 20 aa, Artificial sequence
  Synthetic peptide
TFVYWQPYYGNPQWAIHVRH

SEQ ID NO: 165 - protein, 20 aa, Artificial sequence
  Synthetic peptide
TFVYWQPYVLLELPEGAVRA

SEQ ID NO: 166 - protein, 20 aa, Artificial sequence
  Synthetic peptide
TFVYWQPYVDYVWPIPIAQV

SEQ ID NO: 167 - protein, 11 aa, Artificial sequence
  Synthetic peptide
GWYQPYVDGWR

SEQ ID NO: 168 - protein, 12 aa, Artificial sequence
  Synthetic peptide
RWEQPYVKDGWS

SEQ ID NO: 169 - protein, 12 aa, Artificial sequence
  Synthetic peptide
EWYQPYALGWAR

SEQ ID NO: 170 - protein, 10 aa, Artificial sequence
  Synthetic peptide
GWWQPYARGL

SEQ ID NO: 171 - protein, 12 aa, Artificial sequence
  Synthetic peptide
LFEQPYAKALGL

SEQ ID NO: 172 - protein, 12 aa, Artificial sequence
  Synthetic peptide
GWEQPYARGLAG

SEQ ID NO: 173 - protein, 12 aa, Artificial sequence
  Synthetic peptide
AWVQPYATPLDE

SEQ ID NO: 174 - protein, 12 aa, Artificial sequence
  Synthetic peptide
MWYQPYSSQPAE

SEQ ID NO: 175 - protein, 12 aa, Artificial sequence
  Synthetic peptide
GWTQPYSQQGEV

SEQ ID NO: 176 - protein, 12 aa, Artificial sequence
  Synthetic peptide
DWFQPYSIQSDE

SEQ ID NO: 177 - protein, 11 aa, Artificial sequence
  Synthetic peptide
PWIQPYARGFG

SEQ ID NO: 178 - protein, 12 aa, Artificial sequence
  Synthetic peptide
RPLYWQPYSVQV

SEQ ID NO: 179 - protein, 12 aa, Artificial sequence
  Synthetic peptide
TLIYWQPYSVQI

SEQ ID NO: 180 - protein, 12 aa, Artificial sequence
  Synthetic peptide
RFDYWQPYSDQT

SEQ ID NO: 181 - protein, 12 aa, Artificial sequence
  Synthetic peptide
WHQFVQPYALPL

SEQ ID NO: 182 - protein, 17 aa, Artificial sequence
  Synthetic peptide
EWDSVYWQPYSVQTLLR

SEQ ID NO: 183 - protein, 17 aa, Artificial sequence
  Synthetic peptide
WEQNVYWQPYSVQSFAD

SEQ ID NO: 184 - protein, 16 aa, Artificial sequence
  Synthetic peptide
SDVVYWQPYSVQSLEM

SEQ ID NO: 185 - protein, 17 aa, Artificial sequence
  Synthetic peptide
YYDGVYWQPYSVQVMPA

SEQ ID NO: 186 - protein, 12 aa, Artificial sequence
  Synthetic peptide
SDIWYQPYALPL

SEQ ID NO: 187 - protein, 12 aa, Artificial sequence
  Synthetic peptide
QRIWWQPYALPL

SEQ ID NO: 188 - protein, 12 aa, Artificial sequence
  Synthetic peptide
SRIWWQPYALPL

SEQ ID NO: 189 - protein, 12 aa, Artificial sequence
  Synthetic peptide
RSLYWQPYALPL

SEQ ID NO: 190 - protein, 12 aa, Artificial sequence
  Synthetic peptide
TIIWEQPYALPL

SEQ ID NO: 191 - protein, 12 aa, Artificial sequence
  Synthetic peptide
WETWYQPYALPL

SEQ ID NO: 192 - protein, 12 aa, Artificial sequence
  Synthetic peptide
SYDWEQPYALPL

SEQ ID NO: 193 - protein, 12 aa, Artificial sequence
  Synthetic peptide
SRIWCQPYALPL

SEQ ID NO: 194 - protein, 12 aa, Artificial sequence
  Synthetic peptide
EIMFWQPYALPL

SEQ ID NO: 195 - protein, 12 aa, Artificial sequence
  Synthetic peptide
DYVWQQPYALPL

SEQ ID NO: 196 - protein, 15 aa, Artificial sequence
  Synthetic peptide
MDLLVQWYQPYALPL

SEQ ID NO: 197 - protein, 15 aa, Artificial sequence
  Synthetic peptide
GSKVILWYQPYALPL

SEQ ID NO: 198 - protein, 15 aa, Artificial sequence
  Synthetic peptide
RQGANIWYQPYALPL

SEQ ID NO: 199 - protein, 15 aa, Artificial sequence
  Synthetic peptide
GGGDEPWYQPYALPL

SEQ ID NO: 200 - protein, 15 aa, Artificial sequence
  Synthetic peptide
SQLERTWYQPYALPL

SEQ ID NO: 201 - protein, 15 aa, Artificial sequence
  Synthetic peptide
ETWVREWYQPYALPL

SEQ ID NO: 202 - protein, 15 aa, Artificial sequence
  Synthetic peptide
KKGSTQWYQPYALPL

SEQ ID NO: 203 - protein, 15 aa, Artificial sequence
  Synthetic peptide
LQARMNWYQPYALPL

SEQ ID NO: 204 - protein, 15 aa, Artificial sequence
  Synthetic peptide
EPRSQKWYQPYALPL

SEQ ID NO: 205 - protein, 15 aa, Artificial sequence
  Synthetic peptide
VKQKWRWYQPYALPL

SEQ ID NO: 206 - protein, 15 aa, Artificial sequence
  Synthetic peptide
LRRHDVWYQPYALPL

SEQ ID NO: 207 - protein, 15 aa, Artificial sequence
  Synthetic peptide
RSTASIWYQPYALPL

SEQ ID NO: 208 - protein, 15 aa, Artificial sequence
  Synthetic peptide
ESKEDQWYQPYALPL

SEQ ID NO: 209 - protein, 15 aa, Artificial sequence
  Synthetic peptide
EGLTMKWYQPYALPL

SEQ ID NO: 210 - protein, 15 aa, Artificial sequence
  Synthetic peptide
EGSREGWYQPYALPL

SEQ ID NO: 211 - protein, 12 aa, Artificial sequence
  Synthetic peptide
VIEWWQPYALPL

SEQ ID NO: 212 - protein, 12 aa, Artificial sequence
  Synthetic peptide
VWYWEQPYALPL

SEQ ID NO: 213 - protein, 12 aa, Artificial sequence
  Synthetic peptide
ASEWWQPYALPL

SEQ ID NO: 214 - protein, 12 aa, Artificial sequence
  Synthetic peptide
FYEWWQPYALPL

SEQ ID NO: 215 - protein, 12 aa, Artificial sequence
  Synthetic peptide
EGWWVQPYALPL

SEQ ID NO: 216 - protein, 12 aa, Artificial sequence
  Synthetic peptide
WGEWLQPYALPL

SEQ ID NO: 217 - protein, 12 aa, Artificial sequence
  Synthetic peptide
DYVWEQPYALPL

SEQ ID NO: 218 - protein, 12 aa, Artificial sequence
  Synthetic peptide
AHTWWQPYALPL

SEQ ID NO: 219 - protein, 12 aa, Artificial sequence
  Synthetic peptide
FIEWFQPYALPL

SEQ ID NO: 220 - protein, 12 aa, Artificial sequence
  Synthetic peptide
WLAWEQPYALPL

SEQ ID NO: 221 - protein, 12 aa, Artificial sequence
  Synthetic peptide
VMEWWQPYALPL

SEQ ID NO: 222 - protein, 11 aa, Artificial sequence
  Synthetic peptide
ERMWQPYALPL

SEQ ID NO: 223 - protein, 12 aa, Artificial sequence
  Synthetic peptide
  Misc_feature (2)..(3): Xaa=any amino acid
  Misc_feature (5)..(6): Xaa=any amino acid
NXXWXXPYALPL

SEQ ID NO: 224 - protein, 12 aa, Artificial sequence
  Synthetic peptide
WGNWYQPYALPL

SEQ ID NO: 225 - protein, 12 aa, Artificial sequence
  Synthetic peptide
TLYWEQPYALPL

SEQ ID NO: 226 - protein, 12 aa, Artificial sequence
  Synthetic peptide
VWRWEQPYALPL

SEQ ID NO: 227 - protein, 11 aa, Artificial sequence
  Synthetic peptide
LLWTQPYALPL

SEQ ID NO: 228 - protein, 12 aa, Artificial sequence
  Synthetic peptide
  Misc_feature (5)..(6): Xaa=any amino acid
SRIWXXPYALPL

SEQ ID NO: 229 - protein, 12 aa, Artificial sequence
  Synthetic peptide
SDIWYQPYALPL

SEQ ID NO: 230 - protein, 12 aa, Artificial sequence
  Synthetic peptide
  Misc_feature (5)..(6): Xaa=any amino acid
WGYYXXPYALPL

SEQ ID NO: 231 - protein, 12 aa, Artificial sequence
  Synthetic peptide
TSGWYQPYALPL

SEQ ID NO: 232 - protein, 12 aa, Artificial sequence
  Synthetic peptide
  Misc_feature (5)..(6): Xaa=any amino acid
VHPYXXPYALPL

SEQ ID NO: 233 - protein, 12 aa, Artificial sequence
  Synthetic peptide
EHSYFQPYALPL

SEQ ID NO: 234 - protein, 12 aa, Artificial sequence
  Synthetic peptide
  Misc_feature (1)..(2): Xaa=any amino acid
XXIWYQPYALPL

SEQ ID NO: 235 - protein, 12 aa, Artificial sequence
  Synthetic peptide
AQLHSQPYALPL

SEQ ID NO: 236 - protein, 12 aa, Artificial sequence
  Synthetic peptide
WANWFQPYALPL

SEQ ID NO: 237 - protein, 12 aa, Artificial sequence
  Synthetic peptide
SRLYSQPYALPL

SEQ ID NO: 238 - protein, 12 aa, Artificial sequence
  Synthetic peptide
GVTFSQPYALPL

SEQ ID NO: 239 - protein, 12 aa, Artificial sequence
  Synthetic peptide
SIVWSQPYALPL

SEQ ID NO: 240 - protein, 12 aa, Artificial sequence
  Synthetic peptide
SRDLVQPYALPL

SEQ ID NO: 241 - protein, 17 aa, Artificial sequence
  Synthetic peptide
HWGHVYWQPYSVQDDLG

SEQ ID NO: 242 - protein, 17 aa, Artificial sequence
  Synthetic peptide
SWHSVYWQPYSVQSVPE

SEQ ID NO: 243 - protein, 17 aa, Artificial sequence
  Synthetic peptide
WRDSVYWQPYSVQPESA

SEQ ID NO: 244 - protein, 17 aa, Artificial sequence
  Synthetic peptide
TWDAVYWQPYSVQKWLD

SEQ ID NO: 245 - protein, 17 aa, Artificial sequence
  Synthetic peptide
TPPWVYWQPYSVQSLDP

SEQ ID NO: 246 - protein, 17 aa, Artificial sequence
  Synthetic peptide
YWSSVYWQPYSVQSVHS

SEQ ID NO: 247 - protein, 10 aa, Artificial sequence
  Synthetic peptide
YWYQPYALGL

SEQ ID NO: 248 - protein, 10 aa, Artificial sequence
  Synthetic peptide
YWYQPYALPL

SEQ ID NO: 249 - protein, 10 aa, Artificial sequence
  Synthetic peptide
EWIQPYATGL

SEQ ID NO: 250 - protein, 10 aa, Artificial sequence
  Synthetic peptide
NWEQPYAKPL

SEQ ID NO: 251 - protein, 10 aa, Artificial sequence
  Synthetic peptide
AFYQPYALPL

SEQ ID NO: 252 - protein, 10 aa, Artificial sequence
  Synthetic peptide
FLYQPYALPL

SEQ ID NO: 253 - protein, 10 aa, Artificial sequence
  Synthetic peptide
VCKQPYLEWC

SEQ ID NO: 254 - protein, 21 aa, Artificial sequence
  Synthetic peptide
ETPFTWEESNAYYWQPYALPL

SEQ ID NO: 255 - protein, 21 aa, Artificial sequence
  Synthetic peptide
QGWLTWQDSVDMYWQPYALPL

SEQ ID NO: 256 - protein, 21 aa, Artificial sequence
  Synthetic peptide
FSEAGYTWPENTYWQPYALPL

SEQ ID NO: 257 - protein, 21 aa, Artificial sequence
  Synthetic peptide
TESPGGLDWAKIYWQPYALPL

SEQ ID NO: 258 - protein, 21 aa, Artificial sequence
  Synthetic peptide
DGYDRWRQSGERYWQPYALPL

SEQ ID NO: 259 - protein, 21 aa, Artificial sequence
  Synthetic peptide
TANVSSFEWTPGYWQPYALPL

SEQ ID NO: 260 - protein, 21 aa, Artificial sequence
  Synthetic peptide
SVGEDHNFWTSEYWQPYALPL

SEQ ID NO: 261 - protein, 21 aa, Artificial sequence
  Synthetic peptide
MNDQTSEVSTFPYWQPYALPL

SEQ ID NO: 262 - protein, 21 aa, Artificial sequence
  Synthetic peptide
SWSEAFEQPRNLYWQPYALPL

SEQ ID NO: 263 - protein, 21 aa, Artificial sequence
  Synthetic peptide
QYAEPSALNDWGYWQPYALPL

SEQ ID NO: 264 - protein, 21 aa, Artificial sequence
  Synthetic peptide
NGDWATADWSNYYWQPYALPL

SEQ ID NO: 265 - protein, 15 aa, Artificial sequence
  Synthetic peptide
THDEHIYWQPYALPL

SEQ ID NO: 266 - protein, 21 aa, Artificial sequence
  Synthetic peptide
MLEKTYTTWTPGYWQPYALPL

SEQ ID NO: 267 - protein, 20 aa, Artificial sequence
  Synthetic peptide
WSDPLTRDADLYWQPYALPL

SEQ ID NO: 268 - protein, 21 aa, Artificial sequence
  Synthetic peptide
SDAFTTQDSQAMYWQPYALPL

SEQ ID NO: 269 - protein, 21 aa, Artificial sequence
  Synthetic peptide
GDDAAWRTDSLTYWQPYALPL

SEQ ID NO: 270 - protein, 21 aa, Artificial sequence
  Synthetic peptide
AIIRQLYRWSEMYWQPYALPL

SEQ ID NO: 271 - protein, 21 aa, Artificial sequence
  Synthetic peptide
ENTYSPNWADSMYWQPYALPL

SEQ ID NO: 272 - protein, 21 aa, Artificial sequence
  Synthetic peptide
MNDQTSEVSTFPYWQPYALPL

SEQ ID NO: 273 - protein, 21 aa, Artificial sequence
  Synthetic peptide
SVGEDHNFWTSEYWQPYALPL

SEQ ID NO: 274 - protein, 21 aa, Artificial sequence
  Synthetic peptide
QTPFTWEESNAYYWQPYALPL

SEQ ID NO: 275 - protein, 21 aa, Artificial sequence
  Synthetic peptide
ENPFTWQESNAYYWQPYALPL

SEQ ID NO: 276 - protein, 21 aa, Artificial sequence
  Synthetic peptide
VTPFTWEDSNVFYWQPYALPL

SEQ ID NO: 277 - protein, 21 aa, Artificial sequence
  Synthetic peptide
QIPFTWEQSNAYYWQPYALPL

SEQ ID NO: 278 - protein, 21 aa, Artificial sequence
  Synthetic peptide
QAPLTWQESAAYYWQPYALPL

SEQ ID NO: 279 - protein, 21 aa, Artificial sequence
  Synthetic peptide
EPTFTWEESKATYWQPYALPL

SEQ ID NO: 280 - protein, 21 aa, Artificial sequence
  Synthetic peptide
TTTLTWEESNAYYWQPYALPL

SEQ ID NO: 281 - protein, 21 aa, Artificial sequence
  Synthetic peptide
ESPLTWEESSALYWQPYALPL

SEQ ID NO: 282 - protein, 21 aa, Artificial sequence
  Synthetic peptide
ETPLTWEESNAYYWQPYALPL

SEQ ID NO: 283 - protein, 21 aa, Artificial sequence
  Synthetic peptide
EATFTWAESNAYYWQPYALPL

SEQ ID NO: 284 - protein, 21 aa, Artificial sequence
  Synthetic peptide
EALFTWKESTAYYWQPYALPL

SEQ ID NO: 285 - protein, 20 aa, Artificial sequence
  Synthetic peptide
STPTWEESNAYYWQPYALPL

SEQ ID NO: 286 - protein, 21 aa, Artificial sequence
  Synthetic peptide
ETPFTWEESNAYYWQPYALPL

SEQ ID NO: 287 - protein, 21 aa, Artificial sequence
  Synthetic peptide
KAPFTWEESQAYYWQPYALPL

SEQ ID NO: 288 - protein, 21 aa, Artificial sequence
  Synthetic peptide
STSFTWEESNAYYWQPYALPL

SEQ ID NO: 289 - protein, 21 aa, Artificial sequence
  Synthetic peptide
DSTFTWEESNAYYWQPYALPL

SEQ ID NO: 290 - protein, 21 aa, Artificial sequence
  Synthetic peptide
YIPFTWEESNAYYWQPYALPL

SEQ ID NO: 291 - protein, 21 aa, Artificial sequence
  Synthetic peptide
QTAFTWEESNAYYWQPYALPL

SEQ ID NO: 292 - protein, 21 aa, Artificial sequence
  Synthetic peptide
ETLFTWEESNATYWQPYALPL

SEQ ID NO: 293 - protein, 21 aa, Artificial sequence
  Synthetic peptide
VSSFTWEESNAYYWQPYALPL

SEQ ID NO: 294 - protein, 7 aa, Artificial sequence
  Synthetic peptide
QPYALPL

SEQ ID NO: 295 - protein, 10 aa, Artificial sequence
  Synthetic peptide
  Misc_feature (1)..(1): Xaa=Unsure
  Misc_feature (2)..(2): Ala modified to 1-naphthylalanine at position 2
  Misc_feature (5)..(6): Azetidine is between residues 5 and 6
XAPYQYALPL

SEQ ID NO: 296 - protein, 21 aa, Artificial sequence
  Synthetic peptide
TANVSSFEWTPGYWQPYALPL

SEQ ID NO: 297 - protein, 15 aa, Artificial sequence
  Synthetic peptide
FEWTPGYWQPYALPL

SEQ ID NO: 298 - protein, 14 aa, Artificial sequence
  Synthetic peptide
  Misc_feature (9)..(10): Azetidine is between residues 9 and 10
FEWTPGYWQYALPL

SEQ ID NO: 299 - protein, 14 aa, Artificial sequence
  Synthetic peptide
  Misc_feature (9)..(10): Azetidine is between residues 9 and 10
FEWTPGYYQYALPL

SEQ ID NO: 300 - protein, 21 aa, Artificial sequence
  Synthetic peptide
ETPFTWEESNAYYWQPYALPL

SEQ ID NO: 301 - protein, 17 aa, Artificial sequence
  Synthetic peptide
  Misc_feature (12)..(13): Azetidine is between residues 12 and 13
FTWEESNAYYWQYALPL

SEQ ID NO: 302 - protein, 16 aa, Artificial sequence
  Synthetic peptide
ADVLYWQPYAPVTLWV

SEQ ID NO: 303 - protein, 17 aa, Artificial sequence
  Synthetic peptide
GDVAEYWQPYALPLTSL

SEQ ID NO: 304 - protein, 18 aa, Artificial sequence
  Synthetic peptide
SWTDYGYWQPYALPISGL

SEQ ID NO: 305 - protein, 15 aa, Artificial sequence
  Synthetic peptide
FEWTPGYWQPYALPL

SEQ ID NO: 306 - protein, 14 aa, Artificial sequence
  Synthetic peptide
  Misc_feature (9)..(10): Azetidine is between residues 9 and 10
FEWTPGYWQYALPL

SEQ ID NO: 307 - protein, 15 aa, Artificial sequence
  Synthetic peptide
FEWTPGWYQPYALPL

SEQ ID NO: 308 - protein, 14 aa, Artificial sequence
  Synthetic peptide
  Misc_feature (9)..(10): Azetidine is between residues 9 and 10
FEWTPGWYQYALPL

SEQ ID NO: 309 - protein, 15 aa, Artificial sequence
  Synthetic peptide
FEWTPGYYQPYALPL

SEQ ID NO: 310 - protein, 14 aa, Artificial sequence
  Synthetic peptide
  Misc_feature (9)..(10): Azetidine is between residues 9 and 10
FEWTPGYYQYALPL

SEQ ID NO: 311 - protein, 21 aa, Artificial sequence
  Synthetic peptide
TANVSSFEWTPGYWQPYALPL

SEQ ID NO: 312 - protein, 18 aa, Artificial sequence
  Synthetic peptide
SWTDYGYWQPYALPISGL

SEQ ID NO: 313 - protein, 21 aa, Artificial sequence
  Synthetic peptide
ETPFTWEESNAYYWQPYALPL

SEQ ID NO: 314 - protein, 21 aa, Artificial sequence
  Synthetic peptide
ENTYSPNWADSMYWQPYALPL

SEQ ID NO: 315 - protein, 21 aa, Artificial sequence
  Synthetic peptide
SVGEDHNFWTSEYWQPYALPL

SEQ ID NO: 316 - protein, 21 aa, Artificial sequence
  Synthetic peptide
DGYDRWRQSGERYWQPYALPL

SEQ ID NO: 317 - protein, 15 aa, Artificial sequence
  Synthetic peptide
FEWTPGYWQPYALPL

SEQ ID NO: 318 - protein, 11 aa, Artificial sequence
  Synthetic peptide
FEWTPGYWQPY

SEQ ID NO: 319 - protein, 10 aa, Artificial sequence
  Synthetic peptide
  Misc_feature (9)..(10): Azetidine is between residues 9 and 10
FEWTPGYWQY

SEQ ID NO: 320 - protein, 10 aa, Artificial sequence
  Synthetic peptide
EWTPGYWQPY

SEQ ID NO: 321 - protein, 10 aa, Artificial sequence
  Synthetic peptide
  Misc_feature (9)..(10): Azetidine is between residues 9 and 10
FEWTPGWYQY

SEQ ID NO: 322 - protein, 10 aa, Artificial sequence
  Synthetic peptide
  Misc_feature (9)..(10): Azetidine is between residues 9 and 10
AEWTPGYWQY

SEQ ID NO: 323 - protein, 10 aa, Artificial sequence
  Synthetic peptide
  Misc_feature (9)..(10): Azetidine is between residues 9 and 10
FAWTPGYWQY

SEQ ID NO: 324 - protein, 10 aa, Artificial sequence
  Synthetic peptide
  Misc_feature (9)..(10): Azetidine is between residues 9 and 10
FEATPGYWQY

SEQ ID NO: 325 - protein, 10 aa, Artificial sequence
  Synthetic peptide
  Misc_feature (9)..(10): Azetidine is between residues 9 and 10
FEWAPGYWQY

SEQ ID NO: 326 - protein, 10 aa, Artificial sequence
  Synthetic peptide
  Misc_feature (9)..(10): Azetidine is between residues 9 and 10
FEWTAGYWQY

SEQ ID NO: 327 - protein, 10 aa, Artificial sequence
  Synthetic peptide
  Misc_feature (9)..(10): Azetidine is between residues 9 and 10
FEWTPAYWQY

SEQ ID NO: 328 - protein, 10 aa, Artificial sequence
  Synthetic peptide
  Misc_feature (9)..(10): Azetidine is between residues 9 and 10
FEWTPGAWQY

SEQ ID NO: 329 - protein, 10 aa, Artificial sequence
  Synthetic peptide
  Misc_feature (9)..(10): Azetidine is between residues 9 and 10
FEWTPGYAQY

SEQ ID NO: 330 - protein, 10 aa, Artificial sequence
  Synthetic peptide
  Misc_feature (9)..(10): Azetidine is between residues 9 and 10
FEWTPGYWQA

SEQ ID NO: 331 - protein, 10 aa, Artificial sequence
  Synthetic peptide
  Misc_feature (9)..(10): Azetidine is between residues 9 and 10
FEWTGGYWQY

SEQ ID NO: 332 - protein, 10 aa, Artificial sequence
  Synthetic peptide
  Misc_feature (5)..(5): D-Pro
  Misc_feature (9)..(10): Azetidine is between residues 9 and 10
FEWTPGYWQY

SEQ ID NO: 333 - protein, 9 aa, Artificial sequence
  Synthetic peptide
  Misc_feature (4)..(5): Azetidine is between residues 4 and 5
  Misc_feature (8)..(9): Azetidine is between residues 8 and 9
FEWTGYWQY

SEQ ID NO: 334 - protein, 9 aa, Artificial sequence
  Synthetic peptide
  Misc_feature (4)..(5): Pipecolic acid is between residues 4 and 5
  Misc_feature (8)..(9): Azetidine is between residues 8 and 9
FEWTGYWQY

SEQ ID NO: 335 - protein, 9 aa, Artificial sequence
  Synthetic peptide
  Misc_feature (5)..(6): Aminoisobutyric acid is between residues 5 and 6
  Misc_feature (8)..(9): Azetidine is between residues 8 and 9
FEWTPYWQY

SEQ ID NO: 336 - protein, 10 aa, Artificial sequence
  Synthetic peptide
  Misc_feature (6)..(6): Xaa=Sarcosine
  Misc_feature (9)..(10): Azetidine is between residues 9 and 10
FEWTPXWYQY

SEQ ID NO: 337 - protein, 10 aa, Artificial sequence
  Synthetic peptide
  Misc_feature (5)..(5): Xaa=Sarcosine
  Misc_feature (9)..(10): Azetidine is between residues 9 and 10
FEWTXGYWQY

SEQ ID NO: 338 - protein, 10 aa, Artificial sequence
  Synthetic peptide
  Misc_feature (9)..(10): Azetidine is between residues 9 and 10
FEWTPNYWQY

SEQ ID NO: 339 - protein, 10 aa, Artificial sequence
  Synthetic peptide
  Misc_feature (9)..(10): Azetidine is between residues 9 and 10
FEWTPVYWQY

SEQ ID NO: 340 - protein, 10 aa, Artificial sequence
  Synthetic peptide
  Misc_feature (9)..(10): Azetidine is between residues 9 and 10
FEWTVPYWQY

SEQ ID NO: 341 - protein, 10 aa, Artificial sequence
  Synthetic peptide
  Acetylation (1)..(1): Acetylated phenylalanine at position 1
  Misc_feature (9)..(10): Azetidine is between residues 9 and 10
FEWTPGWYQY

SEQ ID NO: 342 - protein, 10 aa, Artificial sequence
  Synthetic peptide
  Acetylation (1)..(1): Acetylated phenylalanine at position 1
  Misc_feature (9)..(10): Azetidine is between residues 9 and 10
FEWTPGYWQY

SEQ ID NO: 343 - protein, 10 aa, Artificial sequence
  Synthetic peptide
  Misc_feature (1)..(1): Ala modified to 1-naphthylalanine at position 1
  Misc_feature (9)..(10): Azetidine is between residues 9 and 10
AEWTPGYYQY

SEQ ID NO: 344 - protein, 10 aa, Artificial sequence
  Synthetic peptide
  Misc_feature (9)..(10): Azetidine is between residues 9 and 10
YEWTPGYYQY

SEQ ID NO: 345 - protein, 10 aa, Artificial sequence
  Synthetic peptide
  Misc_feature (9)..(10): Azetidine is between residues 9 and 10
FEWVPGYYQY

SEQ ID NO: 346 - protein, 10 aa, Artificial sequence
  Synthetic peptide
  Misc_feature (9)..(10): Azetidine is between residues 9 and 10
FEWTPGYYQY

SEQ ID NO: 347 - protein, 10 aa, Artificial sequence
  Synthetic peptide
  Misc_feature (9)..(10): Azetidine is between residues 9 and 10
FEWTPSYYQY

SEQ ID NO: 348 - protein, 10 aa, Artificial sequence
  Synthetic peptide
  Misc_feature (9)..(10): Azetidine is between residues 9 and 10
FEWTPNYYQY

SEQ ID NO: 349 - protein, 12 aa, Artificial sequence
  Synthetic peptide
  Misc_feature (5)..(5): Ala modified to 1-naphthylalanine at position 5
SHLYAQPYSVQM

SEQ ID NO: 350 - protein, 12 aa, Artificial sequence
  Synthetic peptide
  Misc_feature (5)..(5): Ala modified to 1-naphthylalanine at position 5
TLVYAQPYSLQT

SEQ ID NO: 351 - protein, 12 aa, Artificial sequence
  Synthetic peptide
  Misc_feature (5)..(5): Ala modified to 1-naphthylalanine at position 5
RGDYAQPYSVQS

SEQ ID NO: 352 - protein, 12 aa, Artificial sequence
  Synthetic peptide
  Misc_feature (5)..(5): Ala modified to 1-naphthylalanine at position 5
NMVYAQPYSIQT

SEQ ID NO: 353 - protein, 9 aa, Artificial sequence
  Synthetic peptide
VYWQPYSVQ

SEQ ID NO: 354 - protein, 9 aa, Artificial sequence
  Synthetic peptide
  Misc_feature (3)..(3): Ala modified to 1-naphthylalanine at position 5
VYAQPYSVQ

SEQ ID NO: 355 - protein, 11 aa, Artificial sequence
  Synthetic peptide
  Misc_feature (6)..(7): Azetidine is between residues 6 and 7
TFVYWQYALPL

SEQ ID NO: 356 - protein, 10 aa, Artificial sequence
  Synthetic peptide
  Misc_feature (9)..(10): Azetidine is between residues 9 and 10
  Misc_feature (10)..(10): Phe modified to p-benzoyl-L-phenylalanine at position 10
FEWTPGYYQF

SEQ ID NO: 357 - protein, 10 aa, Artificial sequence
  Synthetic peptide
  Misc_feature (9)..(10): Azetidine is between residues 9 and 10
  Misc_feature (10)..(10): Phe modified to p-benzoyl-L-phenylalanine at position 10
FEWTPGYYQF

SEQ ID NO: 358 - protein, 10 aa, Artificial sequence
  Synthetic peptide
  Misc_feature (8)..(8): Xaa=p-benzoyl-L-phenylalanine
  Misc_feature (9)..(10): Azetidine is between residues 9 and 10
FEWTPGYXQY

SEQ ID NO: 359 - protein, 10 aa, Artificial sequence
  Synthetic peptide
  Acetylation (1)..(1): Acetylated phenylalanine at position 1
  Misc_feature (8)..(8): Phe modified to p-benzoyl-L-phenylalanine at position 8
  Misc_feature (9)..(10): Azetidine is between positions 9 and 10
FEWTPGYFQY

SEQ ID NO: 360 - protein, 10 aa, Artificial sequence
  Synthetic peptide
  Misc_feature (7)..(7): Phe modified to p-benzoyl-L-phenylalanine at position 7
  Misc_feature (9)..(10): Azetidine is between residues 9 and 10
FEWTPGFYQY

SEQ ID NO: 361 - protein, 10 aa, Artificial sequence
  Synthetic peptide
  Acetylation (1)..(1): Acetylated phenylalanine at position 1
  Misc_feature (7)..(7): Phe modified to p-benzoyl-L-phenylalanine at position 7
  Misc_feature (9)..(10): Azetidine is between residues 9 and 10
FEWTPGFYQY

SEQ ID NO: 362 - protein, 10 aa, Artificial sequence
  Synthetic peptide
  Acetylation (1)..(1): Acetylated phenylalanine at position 1
  Misc_feature (3)..(3): Phe modified to p-benzoyl-L-phenylalanine at position 3
  Misc_feature (9)..(10): Azetidine is between residues 9 and 10
FEFTPGYYQY

SEQ ID NO: 363 - protein, 10 aa, Artificial sequence
  Synthetic peptide
  Acetylation (1)..(1): Acetylated phenylalanine at position 1
  Misc_feature (3)..(3): Phe modified to p-benzoyl-L-phenylalanine at position 3
  Misc_feature (9)..(10): Azetidine is between residues 9 and 10
FEFTPGYYQY

SEQ ID NO: 364 - protein, 10 aa, Artificial sequence
  Synthetic peptide
  Misc_feature (1)..(1): Phe modified to p-benzoyl-L-phenylalanine at position 1
  Misc_feature (9)..(10): Azetidine is between residues 9 and 10
FEWTPGYYQY

SEQ ID NO: 365 - protein, 10 aa, Artificial sequence
  Synthetic peptide
  Misc_feature (1)..(1): Phe modified to acetylated p-benzoyl-L-phenylalanine at position 1
  Misc_feature (9)..(10): Azetidine is between residues 9 and 10
FEWTPGYYQY

SEQ ID NO: 366 - protein, 9 aa, Artificial sequence
  Synthetic peptide
VYWQPYSVQ

SEQ ID NO: 367 - protein, 12 aa, Artificial sequence
  Synthetic peptide
RLVYWQPYSVQR

SEQ ID NO: 368 - protein, 12 aa, Artificial sequence
  Synthetic peptide
  Misc_feature (5)..(5): Ala modified to 1-naphthylalanine at position 5
RLVYAQPYSVQR

SEQ ID NO: 369 - protein, 12 aa, Artificial sequence
  Synthetic peptide
RLDYWQPYSVQR

SEQ ID NO: 370 - protein, 12 aa, Artificial sequence
  Synthetic peptide
RLVWFQPYSVQR

SEQ ID NO: 371 - protein, 12 aa, Artificial sequence
  Synthetic peptide
RLVYWQPYSIQR

SEQ ID NO: 372 - protein, 11 aa, Artificial sequence
  Synthetic peptide
DNSSWYDSFLL

SEQ ID NO: 373 - protein, 11 aa, Artificial sequence
  Synthetic peptide
DNTAWYESFLA

SEQ ID NO: 374 - protein, 11 aa, Artificial sequence
  Synthetic peptide
DNTAWYENFLL

SEQ ID NO: 375 - protein, 17 aa, Artificial sequence
  Synthetic peptide
PAREDNTAWYDSFLIWC

SEQ ID NO: 376 - protein, 17 aa, Artificial sequence
  Synthetic peptide
TSEYDNTTWYEKFLASQ

SEQ ID NO: 377 - protein, 17 aa, Artificial sequence
  Synthetic peptide
SQIPDNTAWYQSFLLHG

SEQ ID NO: 378 - protein, 17 aa, Artificial sequence
  Synthetic peptide
SPFIDNTAWYENFLLTY

SEQ ID NO: 379 - protein, 17 aa, Artificial sequence
  Synthetic peptide
EQIYDNTAWYDHFLLSY

SEQ ID NO: 380 - protein, 17 aa, Artificial sequence
  Synthetic peptide
TPFIDNTAWYENFLLTY

SEQ ID NO: 381 - protein, 17 aa, Artificial sequence
  Synthetic peptide
TYTYDNTAWYERFLMSY

SEQ ID NO: 382 - protein, 17 aa, Artificial sequence
  Synthetic peptide
TMTQDNTAWYENFLLSY

SEQ ID NO: 383 - protein, 17 aa, Artificial sequence
  Synthetic peptide
TIDNTAWYANLVQTYPQ

SEQ ID NO: 384 - protein, 17 aa, Artificial sequence
  Synthetic peptide
TIDNTAWYERFLAQYPD

SEQ ID NO: 385 - protein, 17 aa, Artificial sequence
  Synthetic peptide
HIDNTAWYENFLLTYTP

SEQ ID NO: 386 - protein, 17 aa, Artificial sequence
  Synthetic peptide
SQDNTAWYENFLLSYKA

SEQ ID NO: 387 - protein, 17 aa, Artificial sequence
  Synthetic peptide
QIDNTAWYERFLLQYNA

SEQ ID NO: 388 - protein, 17 aa, Artificial sequence
  Synthetic peptide
NQDNTAWYESFLLQYNT

SEQ ID NO: 389 - protein, 17 aa, Artificial sequence
  Synthetic peptide
TIDNTAWYENFLLNHNL

SEQ ID NO: 390 - protein, 17 aa, Artificial sequence
  Synthetic peptide
HYDNTAWYERFLQQGWH

SEQ ID NO: 391 - protein, 21 aa, Artificial sequence
  Synthetic peptide
ETPFTWEESNAYYWQPYALPL

SEQ ID NO: 392 - protein, 21 aa, Artificial sequence
  Synthetic peptide
YIPFTWEESNAYYWQPYALPL

SEQ ID NO: 393 - protein, 21 aa, Artificial sequence
  Synthetic peptide
DGYDRWRQSGERYWQPYALPL

SEQ ID NO: 394 - protein, 9 aa, Artificial sequence
  Synthetic peptide
  Phosphorylation (1)..(1): Phosphotyrosine at position 1
  Misc_feature (2)..(2): Ala modified to 1-naphthylalanine at position 2
  Phosphorylation (3)..(3): Phosphotyrosine at position 3
  Misc_feature (4)..(5): Azetidine is between residues 4 and 5
YAYQYALPL

SEQ ID NO: 395 - protein, 21 aa, Artificial sequence
  Synthetic peptide
TANVSSFEWTPGYWQPYALPL

SEQ ID NO: 396 - protein, 14 aa, Artificial sequence
  Synthetic peptide
  Misc_feature (9)..(10): Azetidine is between residues 9 and 10
FEWTPGYWQYALPL

SEQ ID NO: 397 - protein, 17 aa, Artificial sequence
  Synthetic peptide
FEWTPGYWQPYALPLSD

SEQ ID NO: 398 - protein, 14 aa, Artificial sequence
  Synthetic peptide
  Misc_feature (9)..(10): Azetidine is between residues 9 and 10
FEWTPGYYQYALPL

SEQ ID NO: 399 - protein, 10 aa, Artificial sequence
  Synthetic peptide
  Misc_feature (9)..(10): Azetidine is between residues 9 and 10
FEWTPGYWQY

SEQ ID NO: 400 - protein, 10 aa, Artificial sequence
  Synthetic peptide
  Acetylation (1)..(1): Acetylated phenylalanine at position 1
  Misc_feature (9)..(10): Azetidine is between residues 9 and 10
FEWTPGYWQY

SEQ ID NO: 401 - protein, 10 aa, Artificial sequence
  Synthetic peptide
  Acetylation (1)..(1): Acetylated phenylalanine at position 1
  Misc_feature (9)..(10): Azetidine is between residues 9 and 10
FEWTPGWYQY

SEQ ID NO: 402 - protein, 10 aa, Artificial sequence
  Synthetic peptide
  Acetylation (1)..(1): Acetylated phenylalanine at position 1
  Misc_feature (9)..(10): Azetidine is between residues 9 and 10
FEWTPGYYQY

SEQ ID NO: 403 - protein, 10 aa, Artificial sequence
  Synthetic peptide
  Acetylation (1)..(1): Acetylated phenylalanine at position 1
  Misc_feature (9)..(10): Azetidine is between residues 9 and 10
FEWTPAYWQY

SEQ ID NO: 404 - protein, 10 aa, Artificial sequence
  Synthetic peptide
  Acetylation (1)..(1): Acetylated phenylalanine at position 1
  Misc_feature (9)..(10): Azetidine is between residues 9 and 10
FEWTPAWYQY

SEQ ID NO: 405 - protein, 10 aa, Artificial sequence
  Synthetic peptide
  Acetylation (1)..(1): Acetylated phenylalanine at position 1
  Misc_feature (9)..(10): Azetidine is between residues 9 and 10
FEWTPAYYQY

SEQ ID NO: 406 - protein, 14 aa, Artificial sequence
  Synthetic peptide
  Misc_feature (9)..(10): Azetidine is between residues 9 and 10
FEWTPGYYQYALPL

SEQ ID NO: 407 - protein, 14 aa, Artificial sequence
  Synthetic peptide
  Misc_feature (9)..(10): Azetidine is between residues 9 and 10
FEWTPGYWQYALPL

SEQ ID NO: 408 - protein, 14 aa, Artificial sequence
  Synthetic peptide
  Misc_feature (9)..(10): Azetidine is between residues 9 and 10
FEWTPGWYQYALPL

SEQ ID NO: 409 - protein, 21 aa, Artificial sequence
  Synthetic peptide
TANVSSFEWTPGYWQPYALPL

SEQ ID NO: 410 - protein, 10 aa, Artificial sequence
  Synthetic peptide
  Acetylation (1)..(1): Acetylated phenylalanine at position 1
  Misc_feature (9)..(10): Azetidine is between residues 9 and 10
FEWTPGYWQY

SEQ ID NO: 411 - protein, 10 aa, Artificial sequence
  Synthetic peptide
  Acetylation (1)..(1): Acetylated phenylalanine at position 1
  Misc_feature (9)..(10): Azetidine is between residues 9 and 10
FEWTPGWYQY

SEQ ID NO: 412 - protein, 10 aa, Artificial sequence
  Synthetic peptide
  Acetylation (1)..(1): Acetylated phenylalanine at position 1
  Misc_feature (9)..(10): Azetidine is between residues 9 and 10
FEWTPGYYQY

SEQ ID NO: 413 - protein, 10 aa, Artificial sequence
  Synthetic peptide
  Acetylation (1)..(1): Acetylated phenylalanine at position 1
  Misc_feature (6)..(6): D-Ala
  Misc_feature (9)..(10): Azetidine is between residues 9 and 10
FEWTPAYWQY

SEQ ID NO: 414 - protein, 10 aa, Artificial sequence
  Synthetic peptide
  Acetylation (1)..(1): Acetylated phenylalanine at position 1
  Misc_feature (6)..(6): D-Ala
  Misc_feature (9)..(10): Azetidine is between residues 9 and 10
FEWTPAWYQY

SEQ ID NO: 415 - protein, 10 aa, Artificial sequence
  Synthetic peptide
  Acetylation (1)..(1): Acetylated phenylalanine at position 1
  Misc_feature (6)..(6): D-Ala
  Misc_feature (9)..(10): Azetidine is between residues 9 and 10
FEWTPAYYQY

SEQ ID NO: 416 - protein, 14 aa, Artificial sequence
  Synthetic peptide
  Misc_feature (2)..(2): Xaa=any amino acid
  Misc_feature (4)..(5): Xaa=any amino acid
  Misc_feature (8)..(8): Xaa=any amino acid
  Misc_feature (11)..(11): Xaa=any amino acid
  Misc_feature (13)..(13): Xaa=any amino acid
YXCXXGPXTWXCXP

SEQ ID NO: 417 - protein, 14 aa, Artificial sequence
  Synthetic peptide
  Misc_feature (2)..(2): Xaa=any amino acid
  Misc_feature (4)..(5): Xaa=any amino acid
  Misc_feature (8)..(8): Xaa=any amino acid
  Misc_feature (11)..(11): Xaa=any amino acid
  Misc_feature (13)..(13): Xaa=any amino acid
YXCXXGPXTWXCXP

SEQ ID NO: 418 - protein, 14 aa, Artificial sequence
  Synthetic peptide
  Misc_feature (2)..(2): Xaa=any amino acid
  Misc_feature (4)..(5): Xaa=any amino acid
  Misc_feature (8)..(8): Xaa=any amino acid
  Misc_feature (11)..(11): Xaa=any amino acid
  Misc_feature (13)..(13): Xaa=any amino acid
YXCXXGPXTWXCXP

SEQ ID NO: 419 - protein, 14 aa, Artificial sequence
  Synthetic peptide
  Misc_feature (2)..(2): Xaa=any amino acid
  Misc_feature (4)..(5): Xaa=any amino acid
  Misc_feature (8)..(8): Xaa=any amino acid
  Misc_feature (11)..(11): Xaa=any amino acid
  Misc_feature (13)..(13): Xaa=any amino acid
YXCXXGPXTWXCXP

SEQ ID NO: 420 - protein, 20 aa, Artificial sequence
  Synthetic peptide
GGTYSCHFGPLTWVCKPQGG

SEQ ID NO: 421 - protein, 20 aa, Artificial sequence
  Synthetic peptide
GGDYHCRMGPLTWVCKPLGG

SEQ ID NO: 422 - protein, 20 aa, Artificial sequence
  Synthetic peptide
GGVYACRMGPITWVCSPLGG

SEQ ID NO: 423 - protein, 20 aa, Artificial sequence
  Synthetic peptide
VGNYMCHFGPITWVCRPGGG

SEQ ID NO: 424 - protein, 20 aa, Artificial sequence
  Synthetic peptide
GGLYLCRFGPVTWDCGYKGG

SEQ ID NO: 425 - protein, 40 aa, Artificial sequence
  Synthetic peptide
GGTYSCHFGPLTWVCKPQGGGGTYSCHFGPLTWVCKPQGG

SEQ ID NO: 426 - protein, 20 aa, Artificial sequence
  Synthetic peptide
GGTYSCHFGPLTWVCKPQGG

SEQ ID NO: 427 - protein, 23 aa, Artificial sequence
  Synthetic peptide
GGTYSCHFGPLTWVCKPQGGSSK

SEQ ID NO: 428 - protein, 23 aa, Artificial sequence
  Synthetic peptide
GGTYSCHFGPLTWVCKPQGGSSK

SEQ ID NO: 429 - protein, 23 aa, Artificial sequence
  Synthetic peptide
GGTYSCHFGPLTWVCKPQGGSSK

SEQ ID NO: 430 - protein, 22 aa, Artificial sequence
  Synthetic peptide
GGTYSCHFGPLTWVCKPQGGSS

SEQ ID NO: 431 - protein, 23 aa, Artificial sequence
  Synthetic peptide
GGTYSCHFGPLTWVCKPQGGSSK

SEQ ID NO: 432 - protein, 10 aa, Artificial sequence
  Synthetic peptide
  Misc_feature (2)..(2): Xaa=Arg, His, Leu, or Trp
  Misc_feature (3)..(3): Xaa=Met, Phe, or Ile
  Misc_feature (6)..(6): Xaa=any amino acid
  Misc_feature (7)..(7): Xaa=Asp, Glu, Ile, Leu, or Val
  Misc_feature (9)..(9): Xaa=any amino acid
CXXGPXTWXC

SEQ ID NO: 433 - protein, 19 aa, Artificial sequence
  Synthetic peptide
GGTYSCHGPLTWVCKPQGG

SEQ ID NO: 434 - protein, 19 aa, Artificial sequence
  Synthetic peptide
VGNYMAHMGPITWVCRPGG

SEQ ID NO: 435 - protein, 18 aa, Artificial sequence
  Synthetic peptide
GGPHHVYACRMGPLTWIC

SEQ ID NO: 436 - protein, 18 aa, Artificial sequence
  Synthetic peptide
GGTYSCHFGPLTWVCKPQ

SEQ ID NO: 437 - protein, 20 aa, Artificial sequence
  Synthetic peptide
GGLYACHMGPMTWVCQPLRG

SEQ ID NO: 438 - protein, 22 aa, Artificial sequence
  Synthetic peptide
TIAQYICYMGPETWECRPSPKA

SEQ ID NO: 439 - protein, 13 aa, Artificial sequence
  Synthetic peptide
YSCHFGPLTWVCK

SEQ ID NO: 440 - protein, 11 aa, Artificial sequence
  Synthetic peptide
YCHFGPLTWVC

SEQ ID NO: 441 - protein, 10 aa, Artificial sequence
  Synthetic peptide
  Misc_feature (1)..(1): Xaa=Cys, Ala, or nothing
  Misc_feature (1)..(2): If residue 1 is not Cys or Ala, alpha-amino-gamma-bromobutyric acid or homocysteine (HOC) is before residue 2
  Misc_feature (2)..(2): Xaa=Arg, His, Leu, or Trp
  Misc_feature (3)..(3): Xaa=Met, Phe, or Ile
  Misc_feature (6)..(6): Xaa=any amino acid
  Misc_feature (9)..(9): Xaa=Asp, Glu, Ile, Leu, or Val
  Misc_feature (9)..(9): If residue 10 is not Cys or Ala, alpha-amino-gamma-bromobutyric acid or homocysteine (HOC) is after residue 9
  Misc_feature (10)..(10): Xaa=Cys, Ala, or nothing
XXXGPXTWXX

SEQ ID NO: 442 - protein, 12 aa, Artificial sequence
  Synthetic peptide
  Misc_feature (2)..(2): Xaa=any amino acid
  Misc_feature (2)..(3): If residue 3 is not Cys or Ala, alpha-amino-gamma-bromobutyric acid or homocysteine (HOC) is between residues 2 and 3
  Misc_feature (3)..(3): Xaa=Cys, Ala, or nothing
  Misc_feature (4)..(4): Xaa=Arg, His, Leu, or Trp
  Misc_feature (5)..(5): Xaa=Met, Phe, or Ile
  Misc_feature (8)..(8): Xaa=any amino acid
  Misc_feature (11)..(11): Xaa=Asp, Glu, Ile, Leu, or Val
  Misc_feature (11)..(11): If residue 12 is not Cys or Ala, alpha-amino-gamma-bromobutyric acid or homocysteine (HOC) is after residue 11
  Misc_feature (12)..(12): Xaa=Cys, Ala, or nothing
YXXXXGPXTWXX

SEQ ID NO: 443 - protein, 16 aa, Artificial sequence
  Synthetic peptide
  Misc_feature (1)..(1): Xaa=any amino acid
  Misc_feature (3)..(3): Xaa=any amino acid
  Misc_feature (3)..(4): If residue 4 is not Cys or Ala, alpha-amino-gamma-bromobutyric acid or homocysteine (HOC) is between residues 3 and 4
  Misc_feature (4)..(4): Xaa=Cys, Ala, or nothing
  Misc_feature (5)..(5): Xaa=Arg, His, Leu, or Trp
  Misc_feature (6)..(6): Xaa=Met, Phe, or Ile
  Misc_feature (9)..(9): Xaa=any amino acid
  Misc_feature (12)..(12): Xaa=Asp, Glu, Ile, Leu, or Val
  Misc_feature (12)..(13): If residue 13 is not Cys or Ala, alpha-amino-gamma-bromobutyric acid or homocysteine (HOC) is between residues 12 and 13
  Misc_feature (13)..(13): Xaa=Cys, Ala, or nothing
  Misc_feature (14)..(14): Xaa=any amino acid
  Misc_feature (15)..(15): Xaa=any amino acid
  Misc_feature (16)..(16): Xaa=any amino acid
XYXXXXGPXTWXXXXX

SEQ ID NO: 444 - protein, 16 aa, Artificial sequence
  Synthetic peptide
  Misc_feature (1)..(1): Xaa=any amino acid
  Misc_feature (3)..(3): Xaa=any amino acid
  Misc_feature (5)..(5): Xaa=Arg, His, Leu, or Trp
  Misc_feature (6)..(6): Xaa=Met, Phe, or Ile
  Misc_feature (9)..(9): Xaa=any amino acid
  Misc_feature (12)..(12): Xaa=Asp, Glu, Ile, Leu, or Val
  Misc_feature (14)..(14): Xaa=any amino acid
  Misc_feature (15)..(15): Xaa=any amino acid
  Misc_feature (16)..(16): Xaa=any amino acid
XYXCXXGPXTWXCXXX

SEQ ID NO: 445 - protein, 20 aa, Artificial sequence
  Synthetic peptide
GGLYLCRFGPVTWDCGYKGG

SEQ ID NO: 446 - protein, 20 aa, Artificial sequence
  Synthetic peptide
GGTYSCHFGPLTWVCKPQGG

SEQ ID NO: 447 - protein, 20 aa, Artificial sequence
  Synthetic peptide
GGDYHCRMGPLTWVCKPLGG

SEQ ID NO: 448 - protein, 20 aa, Artificial sequence
  Synthetic peptide
VGNYMCHFGPITWVCRPGGG

SEQ ID NO: 449 - protein, 20 aa, Artificial sequence
  Synthetic peptide
GGVYACRMGPITWVCSPLGG

SEQ ID NO: 450 - protein, 19 aa, Artificial sequence
  Synthetic peptide
VGNYMAHMGPITWVCRPGG

SEQ ID NO: 451 - protein, 18 aa, Artificial sequence
  Synthetic peptide
GGTYSCHFGPLTWVCKPQ

SEQ ID NO: 452 - protein, 20 aa, Artificial sequence
  Synthetic peptide
GGLYACHMGPMTWVCQPLRG

SEQ ID NO: 453 - protein, 22 aa, Artificial sequence
  Synthetic peptide
TIAQYICYMGPETWECRPSPKA

SEQ ID NO: 454 - protein, 13 aa, Artificial sequence
  Synthetic peptide
YSCHFGPLTWVCK

SEQ ID NO: 455 - protein, 11 aa, Artificial sequence
  Synthetic peptide
YCHFGPLTWVC

SEQ ID NO: 456 - protein, 12 aa, Artificial sequence
  Synthetic peptide
SCHFGPLTWVCK

SEQ ID NO: 457 - protein, 12 aa, Artificial sequence
  Synthetic peptide
  Misc_feature (1)..(1): Xaa=any amino acid except Tyrosine
  Misc_feature (1)..(2): If residue 2 is not Cys or Ala, alpha-amino-gamma-bromobutyric acid or homocysteine (HOC)is between residues 1 and 2
  Misc_feature (2)..(2): Xaa=Cys, Ala, or nothing
  Misc_feature (4)..(4): Xaa=Arg, His, Leu, or Trp
  Misc_feature (5)..(5): Xaa=Met, Phe or Ile
  Misc_feature (8)..(8): Xaa=any amino acid
  Misc_feature (11)..(11): Xaa=Asp, Gly, Ile, Leu, or Val
  Misc_feature (11)..(11): If residue 12 is not Cys or Ala, alpha-amino-gamma-bromobutyric acid or homocysteine (HOC)is after residue 11
  Misc_feature (12)..(12): Xaa=Cys, Ala, or nothing
XXXXXGPXTWXX

SEQ ID NO: 458 - protein, 17 aa, Artificial sequence
  Synthetic peptide
  Misc_feature (1)..(1): Xn=Glu, Gly, Asn, Ser, Asp, Gln, Leu, Tyr, Ala, or nothing
  Misc_feature (2)..(2): Xn=Phe, Val, Ala, Lys, Arg, Gly, Ser, Ile, Leu, or nothing
  Misc_feature (3)..(3): Xn=His, Gln, Glu, Gly, Asp, Ala, or Val
  Misc_feature (4)..(4): Xn=Glu, Gly, Val, Ala, Pro, Asp, Thr, or Met
  Misc_feature (6)..(6): Xaa=any amino acid
  Misc_feature (7)..(7): Xaa=any amino acid
  Misc_feature (11)..(12): If residue 12 is not Cys or Ala, alpha-amino-gamma-bromobutyric acid or homocysteine (HOC)is between residues 11 and 12
  Misc_feature (12)..(12): Xaa=Cys, Ala, or nothing
  Misc_feature (14)..(14): Xaa=Arg, His, Leu, or Trp
  Misc_feature (15)..(15): Xaa=Met, Phe, or Ile
  Misc_feature (17)..(17): Xaa=Leu, Ile, Pro, Phe, Met, Gln, or Gly
XXXXCXXGWVGXCXXWX

SEQ ID NO: 459 - protein, 14 aa, Artificial sequence
  Synthetic peptide
IEGPTLRQWLAARA

SEQ ID NO: 460 - protein, 14 aa, Artificial sequence
  Synthetic peptide
IEGPTLRQWLAAKA

SEQ ID NO: 461 - protein, 14 aa, Artificial sequence
  Synthetic peptide
IEGPTLREWLAARA

SEQ ID NO: 462 - protein, 14 aa, Artificial sequence
  Synthetic peptide
IEGPTLRQWLAARA

SEQ ID NO: 463 - protein, 14 aa, Artificial sequence
  Synthetic peptide
IEGPTLRQWLAAKA

SEQ ID NO: 464 - protein, 14 aa, Artificial sequence
  Synthetic peptide
IEGPTLRQCLAARA

SEQ ID NO: 465 - protein, 14 aa, Artificial sequence
  Synthetic peptide
IEGPTLRQWLAARA

SEQ ID NO: 466 - protein, 14 aa, Artificial sequence
  Synthetic peptide
IEGPTLRQWLAARA

SEQ ID NO: 467 - protein, 28 aa, Artificial sequence
  Synthetic peptide
IEGPTLRQCLAARAIEGPTLRQWLAARA

SEQ ID NO: 468 - protein, 28 aa, Artificial sequence
  Synthetic peptide
IEGPTLRQWLAARAIEGPTLRQCLAARA

SEQ ID NO: 469 - protein, 9 aa, Artificial sequence
  Synthetic peptide
  Misc_feature (6)..(8): Xaa can be any naturally occurring amino acid
VRDQIXXXL

SEQ ID NO: 470 - protein, 6 aa, Artificial sequence
  Synthetic peptide
TLREWL

SEQ ID NO: 471 - protein, 10 aa, Artificial sequence
  Synthetic peptide
GRVRDQVAGW

SEQ ID NO: 472 - protein, 10 aa, Artificial sequence
  Synthetic peptide
GRVKDQIAQL

SEQ ID NO: 473 - protein, 10 aa, Artificial sequence
  Synthetic peptide
GVRDQVSWAL

SEQ ID NO: 474 - protein, 10 aa, Artificial sequence
  Synthetic peptide
ESVREQVMKY

SEQ ID NO: 475 - protein, 10 aa, Artificial sequence
  Synthetic peptide
SVRSQISASL

SEQ ID NO: 476 - protein, 10 aa, Artificial sequence
  Synthetic peptide
GVRETVYRHM

SEQ ID NO: 477 - protein, 11 aa, Artificial sequence
  Synthetic peptide
GVREVIVMHML

SEQ ID NO: 478 - protein, 11 aa, Artificial sequence
  Synthetic peptide
GRVRDQIWAAL

SEQ ID NO: 479 - protein, 11 aa, Artificial sequence
  Synthetic peptide
AGVRDQILIWL

SEQ ID NO: 480 - protein, 11 aa, Artificial sequence
  Synthetic peptide
GRVRDQIMLSL

SEQ ID NO: 481 - protein, 11 aa, Artificial sequence
  Synthetic peptide
  Misc_feature (8)..(10): Xaa=any amino acid
GRVRDQIXXXL

SEQ ID NO: 482 - protein, 10 aa, Artificial sequence
  Synthetic peptide
CTLRQWLQGC

SEQ ID NO: 483 - protein, 10 aa, Artificial sequence
  Synthetic peptide
CTLQEFLEGC

SEQ ID NO: 484 - protein, 10 aa, Artificial sequence
  Synthetic peptide
CTRTEWLHGC

SEQ ID NO: 485 - protein, 12 aa, Artificial sequence
  Synthetic peptide
CTLREWLHGGFC

SEQ ID NO: 486 - protein, 12 aa, Artificial sequence
  Synthetic peptide
CTLREWVFAGLC

SEQ ID NO: 487 - protein, 13 aa, Artificial sequence
  Synthetic peptide
CTLRQWLILLGMC

SEQ ID NO: 488 - protein, 14 aa, Artificial sequence
  Synthetic peptide
CTLAEFLASGVEQC

SEQ ID NO: 489 - protein, 14 aa, Artificial sequence
  Synthetic peptide
CSLQEFLSHGGYVC

SEQ ID NO: 490 - protein, 14 aa, Artificial sequence
  Synthetic peptide
CTLREFLDPTTAVC

SEQ ID NO: 491 - protein, 14 aa, Artificial sequence
  Synthetic peptide
CTLKEWLVSHEVWC

SEQ ID NO: 492 - protein, 14 aa, Artificial sequence
  Synthetic peptide
  Misc_feature (8)..(11): Xaa=any amino acid or nothing
  Misc_feature (12)..(13): Xaa=any amino acid
CTLREWLXXXXXXC

SEQ ID NO: 493 - protein, 10 aa, Artificial sequence
  Synthetic peptide
REGPTLRQWM

SEQ ID NO: 494 - protein, 10 aa, Artificial sequence
  Synthetic peptide
EGPTLRQWLA

SEQ ID NO: 495 - protein, 10 aa, Artificial sequence
  Synthetic peptide
ERGPFWAKAC

SEQ ID NO: 496 - protein, 10 aa, Artificial sequence
  Synthetic peptide
REGPRCVMWM

SEQ ID NO: 497 - protein, 14 aa, Artificial sequence
  Synthetic peptide
CGTEGPTLSTWLDC

SEQ ID NO: 498 - protein, 14 aa, Artificial sequence
  Synthetic peptide
CEQDGPTLLEWLKC

SEQ ID NO: 499 - protein, 14 aa, Artificial sequence
  Synthetic peptide
CELVGPSLMSWLTC

SEQ ID NO: 500 - protein, 14 aa, Artificial sequence
  Synthetic peptide
CLTGPFVTQWLYEC

SEQ ID NO: 501 - protein, 14 aa, Artificial sequence
  Synthetic peptide
CRAGPTLLEWLTLC

SEQ ID NO: 502 - protein, 14 aa, Artificial sequence
  Synthetic peptide
CADGPTLREWISFC

SEQ ID NO: 503 - protein, 15 aa, Artificial sequence
  Synthetic peptide
  Misc_feature (2)..(2): Xaa=any amino acid or nothing
  Misc_feature (3)..(3): Xaa=any amino acid
  Misc_feature (13)..(13): Xaa=any amino acid or nothing
  Misc_feature (14)..(14): Xaa=any amino acid
CXXEGPTLREWLXXC

SEQ ID NO: 504 - protein, 16 aa, Artificial sequence
  Synthetic peptide
GGCTLREWLHGGFCGG

SEQ ID NO: 505 - protein, 18 aa, Artificial sequence
  Synthetic peptide
GGCADGPTLREWISFCGG

SEQ ID NO: 506 - protein, 19 aa, Artificial sequence
  Synthetic peptide
GNADGPTLRQWLEGRRPKN

SEQ ID NO: 507 - protein, 19 aa, Artificial sequence
  Synthetic peptide
LAIEGPTLRQWLHGNGRDT

SEQ ID NO: 508 - protein, 19 aa, Artificial sequence
  Synthetic peptide
HGRVGPTLREWKTQVATKK

SEQ ID NO: 509 - protein, 18 aa, Artificial sequence
  Synthetic peptide
TIKGPTLRQWLKSREHTS

SEQ ID NO: 510 - protein, 18 aa, Artificial sequence
  Synthetic peptide
ISDGPTLKEWLSVTRGAS

SEQ ID NO: 511 - protein, 18 aa, Artificial sequence
  Synthetic peptide
SIEGPTLREWLTSRTPHS

SEQ ID NO: 512 - protein, 5 aa, Artificial sequence
  Synthetic peptide
EEDCK

SEQ ID NO: 513 - protein, 5 aa, Artificial sequence
  Synthetic peptide
EEDCK

SEQ ID NO: 514 - protein, 4 aa, Artificial sequence
  Synthetic peptide
  Misc_feature (3)..(4): Non-amino acid moiety between residues 3 and 4
EEDK

SEQ ID NO: 515 - protein, 4 aa, Artificial sequence
  Synthetic peptide
  Misc_feature (3)..(4): Non-amino acid moiety between residues 3 and 4
EEDK

SEQ ID NO: 516 - protein, 4 aa, Artificial sequence
  Synthetic peptide
  Misc_feature (3)..(4): Non-amino acid moiety between residues 3 and 4
EEDK

SEQ ID NO: 517 - protein, 4 aa, Artificial sequence
  Synthetic peptide
  Misc_feature (3)..(4): Non-amino acid moiety between residues 3 and 4
EEDK

SEQ ID NO: 518 - protein, 3 aa, Artificial sequence
  Synthetic peptide
  Misc_feature (2)..(3): Non-amino acid moiety between residues 2 and 3
SDK

SEQ ID NO: 519 - protein, 3 aa, Artificial sequence
  Synthetic peptide
  Misc_feature (2)..(3): Non-amino acid moiety between residues 2 and 3
SDK

SEQ ID NO: 520 - protein, 5 aa, Artificial sequence
  Synthetic peptide
EEDCK

SEQ ID NO: 521 - protein, 5 aa, Artificial sequence
  Synthetic peptide
  Misc_feature (4)..(4): Xaa=any amino acid
EEDXK

SEQ ID NO: 522 - protein, 11 aa, Artificial sequence
  Synthetic peptide
YCFTASENHCY

SEQ ID NO: 523 - protein, 11 aa, Artificial sequence
  Synthetic peptide
YCFTNSENHCY

SEQ ID NO: 524 - protein, 11 aa, Artificial sequence
  Synthetic peptide
YCFTRSENHCY

SEQ ID NO: 525 - protein, 9 aa, Artificial sequence
  Synthetic peptide
FCASENHCY

SEQ ID NO: 526 - protein, 9 aa, Artificial sequence
  Synthetic peptide
YCASENHCY

SEQ ID NO: 527 - protein, 9 aa, Artificial sequence
  Synthetic peptide
FCNSENHCY

SEQ ID NO: 528 - protein, 9 aa, Artificial sequence
  Synthetic peptide
FCNSENRCY

SEQ ID NO: 529 - protein, 10 aa, Artificial sequence
  Synthetic peptide
FCNSVENRCY

SEQ ID NO: 530 - protein, 11 aa, Artificial sequence
  Synthetic peptide
YCSQSVSNDCF

SEQ ID NO: 531 - protein, 9 aa, Artificial sequence
  Synthetic peptide
FCVSNDRCY

SEQ ID NO: 532 - protein, 11 aa, Artificial sequence
  Synthetic peptide
YCRKELGQVCY

SEQ ID NO: 533 - protein, 9 aa, Artificial sequence
  Synthetic peptide
YCKEPGQCY

SEQ ID NO: 534 - protein, 9 aa, Artificial sequence
  Synthetic peptide
YCRKEMGCY

SEQ ID NO: 535 - protein, 9 aa, Artificial sequence
  Synthetic peptide
FCRKEMGCY

SEQ ID NO: 536 - protein, 9 aa, Artificial sequence
  Synthetic peptide
YCWSQNLCY

SEQ ID NO: 537 - protein, 10 aa, Artificial sequence
  Synthetic peptide
YCELSQYLCY

SEQ ID NO: 538 - protein, 9 aa, Artificial sequence
  Synthetic peptide
YCWSQNYCY

SEQ ID NO: 539 - protein, 9 aa, Artificial sequence
  Synthetic peptide
YCWSQYLCY

SEQ ID NO: 540 - protein, 15 aa, Artificial sequence
  Synthetic peptide
DFLPHYKNTSLGHRP

SEQ ID NO: 541 - protein, 7 aa, Artificial sequence
  Synthetic peptide
  Misc_feature (2)..(2): Xaa=any amino acid
  Misc_feature (5)..(5): Xaa=any amino acid
  Misc_feature (7)..(7): Xaa=any amino acid
RXETXWX

SEQ ID NO: 542 - protein, 7 aa, Artificial sequence
  Synthetic peptide
  Misc_feature (2)..(2): Xaa=any amino acid
  Misc_feature (5)..(5): Xaa=any amino acid
  Misc_feature (7)..(7): Xaa=any amino acid
RXETXWX

SEQ ID NO: 543 - protein, 5 aa, Artificial sequence
  Synthetic peptide
  Misc_feature (5)..(5): Xaa=any amino acid
RGDGX

SEQ ID NO: 544 - protein, 7 aa, Artificial sequence
  Synthetic peptide
  Misc_feature (6)..(6): Xaa=any amino acid
CRGDGXC

SEQ ID NO: 545 - protein, 9 aa, Artificial sequence
  Synthetic peptide
  Misc_feature (2)..(3): Xaa=any amino acid
  Misc_feature (7)..(8): Xaa=any amino acid
CXXRLDXXC

SEQ ID NO: 546 - protein, 9 aa, Artificial sequence
  Synthetic peptide
CARRLDAPC

SEQ ID NO: 547 - protein, 9 aa, Artificial sequence
  Synthetic peptide
CPSRLDSPC

SEQ ID NO: 548 - protein, 9 aa, Artificial sequence
  Synthetic peptide
  Misc_feature (1)..(3): Xaa=any amino acid
  Misc_feature (7)..(9): Xaa=any amino acid
XXXRGDXXX

SEQ ID NO: 549 - protein, 9 aa, Artificial sequence
  Synthetic peptide
  Misc_feature (2)..(2): Xaa=any amino acid
  Misc_feature (8)..(8): Xaa=any amino acid
CXCRGDCXC

SEQ ID NO: 550 - protein, 9 aa, Artificial sequence
  Synthetic peptide
CDCRGDCFC

SEQ ID NO: 551 - protein, 9 aa, Artificial sequence
  Synthetic peptide
CDCRGDCLC

SEQ ID NO: 552 - protein, 9 aa, Artificial sequence
  Synthetic peptide
CLCRGDCIC

SEQ ID NO: 553 - protein, 16 aa, Artificial sequence
  Synthetic peptide
  Misc_feature (1)..(2): Xaa=any amino acid
  Misc_feature (5)..(7): Xaa=any amino acid
  Misc_feature (8)..(11): Xaa=any amino acid or nothing
  Misc_feature (12)..(12): Xaa=any amino acid
  Misc_feature (13)..(16): Xaa=any amino acid or nothing
XXDDXXXXXXXXXXXX

SEQ ID NO: 554 - protein, 19 aa, Artificial sequence
  Synthetic peptide
  Misc_feature (1)..(3): Xaa=any amino acid
  Misc_feature (6)..(9): Xaa=any amino acid
  Misc_feature (10)..(13): Xaa=any amino acid or nothing
  Misc_feature (14)..(14): Xaa=any amino acid
  Misc_feature (15)..(19): Xaa=any amino acid or nothing
XXXDDXXXXXXXXXXXXXX

SEQ ID NO: 555 - protein, 8 aa, Artificial sequence
  Synthetic peptide
CWDDGWLC

SEQ ID NO: 556 - protein, 9 aa, Artificial sequence
  Synthetic peptide
CWDDLWWLC

SEQ ID NO: 557 - protein, 8 aa, Artificial sequence
  Synthetic peptide
CWDDGLMC

SEQ ID NO: 558 - protein, 8 aa, Artificial sequence
  Synthetic peptide
CWDDGWMC

SEQ ID NO: 559 - protein, 9 aa, Artificial sequence
  Synthetic peptide
CSWDDGWLC

SEQ ID NO: 560 - protein, 9 aa, Artificial sequence
  Synthetic peptide
CPDDLWWLC

SEQ ID NO: 561 - protein, 13 aa, Artificial sequence
  Synthetic peptide
CGRECPRLCQSSC

SEQ ID NO: 562 - protein, 13 aa, Artificial sequence
  Synthetic peptide
CNGRCVSGCAGRC

SEQ ID NO: 563 - protein, 8 aa, Artificial sequence
  Synthetic peptide
CLSGSLSC

SEQ ID NO: 564 - protein, 6 aa, Artificial sequence
  Synthetic peptide
NGRAHA

SEQ ID NO: 565 - protein, 5 aa, Artificial sequence
  Synthetic peptide
CNGRC

SEQ ID NO: 566 - protein, 9 aa, Artificial sequence
  Synthetic peptide
CDCRGDCFC

SEQ ID NO: 567 - protein, 7 aa, Artificial sequence
  Synthetic peptide
CGSLVRC

SEQ ID NO: 568 - protein, 5 aa, Artificial sequence
  Synthetic peptide
  Misc_feature (3)..(4): Xaa=any amino acid
DLXXL

SEQ ID NO: 569 - protein, 12 aa, Artificial sequence
  Synthetic peptide
RTDLDSLRTYTL

SEQ ID NO: 570 - protein, 10 aa, Artificial sequence
  Synthetic peptide
RTDLDSLRTY

SEQ ID NO: 571 - protein, 9 aa, Artificial sequence
  Synthetic peptide
RTDLDSLRT

SEQ ID NO: 572 - protein, 8 aa, Artificial sequence
  Synthetic peptide
RTDLDSLR

SEQ ID NO: 573 - protein, 12 aa, Artificial sequence
  Synthetic peptide
GDLDLLKLRLTL

SEQ ID NO: 574 - protein, 12 aa, Artificial sequence
  Synthetic peptide
GDLHSLRQLLSR

SEQ ID NO: 575 - protein, 12 aa, Artificial sequence
  Synthetic peptide
RDDLHMLRLQLW

SEQ ID NO: 576 - protein, 12 aa, Artificial sequence
  Synthetic peptide
SSDLHALKKRYG

SEQ ID NO: 577 - protein, 12 aa, Artificial sequence
  Synthetic peptide
RGDLKQLSELTW

SEQ ID NO: 578 - protein, 12 aa, Artificial sequence
  Synthetic peptide
RGDLAALSAPPV

SEQ ID NO: 579 - protein, 12 aa, Artificial sequence
  Synthetic peptide
DITWDQLWDLMK

SEQ ID NO: 580 - protein, 12 aa, Artificial sequence
  Synthetic peptide
DITWDELWKIMN

SEQ ID NO: 581 - protein, 12 aa, Artificial sequence
  Synthetic peptide
DYTWFELWDMMQ

SEQ ID NO: 582 - protein, 12 aa, Artificial sequence
  Synthetic peptide
QITWAQLWNMMK

SEQ ID NO: 583 - protein, 12 aa, Artificial sequence
  Synthetic peptide
DMTWHDLWTLMS

SEQ ID NO: 584 - protein, 12 aa, Artificial sequence
  Synthetic peptide
DYSWHDLWEMMS

SEQ ID NO: 585 - protein, 12 aa, Artificial sequence
  Synthetic peptide
EITWDQLWEVMN

SEQ ID NO: 586 - protein, 12 aa, Artificial sequence
  Synthetic peptide
HVSWEQLWDIMN

SEQ ID NO: 587 - protein, 12 aa, Artificial sequence
  Synthetic peptide
HITWDQLWRIMT

SEQ ID NO: 588 - protein, 13 aa, Artificial sequence
  Synthetic peptide
RNMSWLELWEHMK

SEQ ID NO: 589 - protein, 18 aa, Artificial sequence
  Synthetic peptide
AEWTWDQLWHVMNPAESQ

SEQ ID NO: 590 - protein, 14 aa, Artificial sequence
  Synthetic peptide
HRAEWLALWEQMSP

SEQ ID NO: 591 - protein, 14 aa, Artificial sequence
  Synthetic peptide
KKEDWLALWRIMSV

SEQ ID NO: 592 - protein, 11 aa, Artificial sequence
  Synthetic peptide
ITWDQLWDLMK

SEQ ID NO: 593 - protein, 12 aa, Artificial sequence
  Synthetic peptide
DITWDQLWDLMK

SEQ ID NO: 594 - protein, 12 aa, Artificial sequence
  Synthetic peptide
DITWDQLWDLMK

SEQ ID NO: 595 - protein, 12 aa, Artificial sequence
  Synthetic peptide
DITWDQLWDLMK

SEQ ID NO: 596 - protein, 16 aa, Artificial sequence
  Synthetic peptide
CQNRYTDLVAIQNKNE

SEQ ID NO: 597 - protein, 17 aa, Artificial sequence
  Synthetic peptide
AENWADNEPNNKRNNED

SEQ ID NO: 598 - protein, 19 aa, Artificial sequence
  Synthetic peptide
RKNNKTWTWVGTKKALTNE

SEQ ID NO: 599 - protein, 13 aa, Artificial sequence
  Synthetic peptide
KKALTNEAENWAD

SEQ ID NO: 600 - protein, 16 aa, Artificial sequence
  Synthetic peptide
  Misc_feature (3)..(3): Xaa=any amino acid
  Misc_feature (15)..(15): Xaa=any amino acid
CQXRYTDLVAIQNKXE

SEQ ID NO: 601 - protein, 19 aa, Artificial sequence
  Synthetic peptide
  Misc_feature (3)..(3): Xaa=any amino acid
  Misc_feature (5)..(6): Xaa=any amino acid
  Misc_feature (13)..(13): Xaa=any amino acid
  Misc_feature (15)..(15): Xaa=any amino acid
RKXNXXWTWVGTXKXLTEE

SEQ ID NO: 602 - protein, 17 aa, Artificial sequence
  Synthetic peptide
  Misc_feature (13)..(13): Xaa=any amino acid
  Misc_feature (15)..(15): Xaa=any amino acid
AENWADGEPNNKXNXED

SEQ ID NO: 603 - protein, 16 aa, Artificial sequence
  Synthetic peptide
  Misc_feature (2)..(4): Xaa=any amino acid
  Misc_feature (7)..(7): Xaa=any amino acid
  Misc_feature (15)..(15): Xaa=any amino acid
CXXXYTXLVAIQNKXE

SEQ ID NO: 604 - protein, 19 aa, Artificial sequence
  Synthetic peptide
  Misc_feature (3)..(6): Xaa=any amino acid
  Misc_feature (8)..(8): Xaa=any amino acid
  Misc_feature (13)..(13): Xaa=any amino acid
  Misc_feature (15)..(15): Xaa=any amino acid
  Misc_feature (18)..(18): Xaa=any amino acid
RKXXXXWXWVGTXKXLTXE

SEQ ID NO: 605 - protein, 16 aa, Artificial sequence
  Synthetic peptide
  Misc_feature (2)..(2): Xaa=any amino acid
  Misc_feature (5)..(7): Xaa=any amino acid
  Misc_feature (12)..(14): Xaa=any amino acid
AXNWXXXEPNNXXXED

SEQ ID NO: 606 - protein, 13 aa, Artificial sequence
  Synthetic peptide
  Misc_feature (1)..(1): Xaa=any amino acid
  Misc_feature (3)..(3): Xaa=any amino acid
  Misc_feature (6)..(6): Xaa=any amino acid
  Misc_feature (9)..(9): Xaa=any amino acid
  Misc_feature (12)..(13): Xaa=any amino acid
XKXKTXEAXNWXX

SEQ ID NO: 607 - protein, 33 aa, Artificial sequence
  Synthetic peptide
GFFALIPKIISSPLFKTLLSAVGSALSSSGGQQ

SEQ ID NO: 608 - protein, 33 aa, Artificial sequence
  Synthetic peptide
GFFALIPKIISSPLFKTLLSAVGSALSSSGGQE

SEQ ID NO: 609 - protein, 22 aa, Artificial sequence
  Synthetic peptide
GFFALIPKIISSPLFKTLLSAV

SEQ ID NO: 610 - protein, 22 aa, Artificial sequence
  Synthetic peptide
GFFALIPKIISSPLFKTLLSAV

SEQ ID NO: 611 - protein, 23 aa, Artificial sequence
  Synthetic peptide
KGFFALIPKIISSPLFKTLLSAV

SEQ ID NO: 612 - protein, 24 aa, Artificial sequence
  Synthetic peptide
KKGFFALIPKIISSPLFKTLLSAV

SEQ ID NO: 613 - protein, 24 aa, Artificial sequence
  Synthetic peptide
KKGFFALIPKIISSPLFKTLLSAV

SEQ ID NO: 614 - protein, 11 aa, Artificial sequence
  Synthetic peptide
GFFALIPKIIS

SEQ ID NO: 615 - protein, 26 aa, Artificial sequence
  Synthetic peptide
GIGAVLKVLTTGLPALISWIKRKRQQ

SEQ ID NO: 616 - protein, 26 aa, Artificial sequence
  Synthetic peptide
GIGAVLKVLTTGLPALISWIKRKRQQ

SEQ ID NO: 617 - protein, 26 aa, Artificial sequence
  Synthetic peptide
GIGAVLKVLTTGLPALISWIKRKRQQ

SEQ ID NO: 618 - protein, 22 aa, Artificial sequence
  Synthetic peptide
GIGAVLKVLTTGLPALISWIKR

SEQ ID NO: 619 - protein, 19 aa, Artificial sequence
  Synthetic peptide
AVLKVLTTGLPALISWIKR

SEQ ID NO: 620 - protein, 12 aa, Artificial sequence
  Synthetic peptide
KLLLLLKLLLLK

SEQ ID NO: 621 - protein, 12 aa, Artificial sequence
  Synthetic peptide
KLLLKLLLKLLK

SEQ ID NO: 622 - protein, 12 aa, Artificial sequence
  Synthetic peptide
KLLLKLKLKLLK

SEQ ID NO: 623 - protein, 12 aa, Artificial sequence
  Synthetic peptide
KKLLKLKLKLKK

SEQ ID NO: 624 - protein, 12 aa, Artificial sequence
  Synthetic peptide
KLLLKLLLKLLK

SEQ ID NO: 625 - protein, 12 aa, Artificial sequence
  Synthetic peptide
KLLLKLKLKLLK

SEQ ID NO: 626 - protein, 6 aa, Artificial sequence
  Synthetic peptide
KLLLLK

SEQ ID NO: 627 - protein, 8 aa, Artificial sequence
  Synthetic peptide
KLLLKLLK

SEQ ID NO: 628 - protein, 12 aa, Artificial sequence
  Synthetic peptide
KLLLKLKLKLLK

SEQ ID NO: 629 - protein, 12 aa, Artificial sequence
  Synthetic peptide
KLLLKLKLKLLK

SEQ ID NO: 630 - protein, 12 aa, Artificial sequence
  Synthetic peptide
KLLLKLKLKLLK

SEQ ID NO: 631 - protein, 12 aa, Artificial sequence
  Synthetic peptide
KAAAKAAAKAAK

SEQ ID NO: 632 - protein, 12 aa, Artificial sequence
  Synthetic peptide
KVVVKVVVKVVK

SEQ ID NO: 633 - protein, 12 aa, Artificial sequence
  Synthetic peptide
KVVVKVKVKVVK

SEQ ID NO: 634 - protein, 11 aa, Artificial sequence
  Synthetic peptide
KVVVKVKVKVK

SEQ ID NO: 635 - protein, 12 aa, Artificial sequence
  Synthetic peptide
KVVVKVKVKVVK

SEQ ID NO: 636 - protein, 6 aa, Artificial sequence
  Synthetic peptide
KLILKL

SEQ ID NO: 637 - protein, 6 aa, Artificial sequence
  Synthetic peptide
KVLHLL

SEQ ID NO: 638 - protein, 6 aa, Artificial sequence
  Synthetic peptide
LKLRLL

SEQ ID NO: 639 - protein, 6 aa, Artificial sequence
  Synthetic peptide
KPLHLL

SEQ ID NO: 640 - protein, 8 aa, Artificial sequence
  Synthetic peptide
KLILKLVR

SEQ ID NO: 641 - protein, 8 aa, Artificial sequence
  Synthetic peptide
KVFHLLHL

SEQ ID NO: 642 - protein, 8 aa, Artificial sequence
  Synthetic peptide
HKFRILKL

SEQ ID NO: 643 - protein, 8 aa, Artificial sequence
  Synthetic peptide
KPFHILHL

SEQ ID NO: 644 - protein, 12 aa, Artificial sequence
  Synthetic peptide
KIIIKIKIKIIK

SEQ ID NO: 645 - protein, 12 aa, Artificial sequence
  Synthetic peptide
KIIIKIKIKIIK

SEQ ID NO: 646 - protein, 12 aa, Artificial sequence
  Synthetic peptide
KIIIKIKIKIIK

SEQ ID NO: 647 - protein, 12 aa, Artificial sequence
  Synthetic peptide
KIPIKIKIKIPK

SEQ ID NO: 648 - protein, 12 aa, Artificial sequence
  Synthetic peptide
KIPIKIKIKIVK

SEQ ID NO: 649 - protein, 12 aa, Artificial sequence
  Synthetic peptide
RIIIRIRIRIIR

SEQ ID NO: 650 - protein, 12 aa, Artificial sequence
  Synthetic peptide
RIIIRIRIRIIR

SEQ ID NO: 651 - protein, 12 aa, Artificial sequence
  Synthetic peptide
RIIIRIRIRIIR

SEQ ID NO: 652 - protein, 12 aa, Artificial sequence
  Synthetic peptide
RIVIRIRIRLIR

SEQ ID NO: 653 - protein, 12 aa, Artificial sequence
  Synthetic peptide
RIIVRIRLRIIR

SEQ ID NO: 654 - protein, 12 aa, Artificial sequence
  Synthetic peptide
RIGIRLRVRIIR

SEQ ID NO: 655 - protein, 12 aa, Artificial sequence
  Synthetic peptide
KIVIRIRIRLIR

SEQ ID NO: 656 - protein, 12 aa, Artificial sequence
  Synthetic peptide
RIAVKWRLRFIK

SEQ ID NO: 657 - protein, 12 aa, Artificial sequence
  Synthetic peptide
KIGWKLRVRIIR

SEQ ID NO: 658 - protein, 12 aa, Artificial sequence
  Synthetic peptide
KKIGWLIIRVRR

SEQ ID NO: 659 - protein, 14 aa, Artificial sequence
  Synthetic peptide
RIVIRIRIRLIRIR

SEQ ID NO: 660 - protein, 14 aa, Artificial sequence
  Synthetic peptide
RIIVRIRLRIIRVR

SEQ ID NO: 661 - protein, 14 aa, Artificial sequence
  Synthetic peptide
RIGIRLRVRIIRRV

SEQ ID NO: 662 - protein, 16 aa, Artificial sequence
  Synthetic peptide
KIVIRIRARLIRIRIR

SEQ ID NO: 663 - protein, 16 aa, Artificial sequence
  Synthetic peptide
RIIVKIRLRIIKKIRL

SEQ ID NO: 664 - protein, 16 aa, Artificial sequence
  Synthetic peptide
KIGIKARVRIIRVKII

SEQ ID NO: 665 - protein, 16 aa, Artificial sequence
  Synthetic peptide
RIIVHIRLRIIHHIRL

SEQ ID NO: 666 - protein, 16 aa, Artificial sequence
  Synthetic peptide
HIGIKAHVRIIRVHII

SEQ ID NO: 667 - protein, 16 aa, Artificial sequence
  Synthetic peptide
RIYVKIHLRYIKKIRL

SEQ ID NO: 668 - protein, 16 aa, Artificial sequence
  Synthetic peptide
KIGHKARVHIIRYKII

SEQ ID NO: 669 - protein, 16 aa, Artificial sequence
  Synthetic peptide
RIYVKPHPRYIKKIRL

SEQ ID NO: 670 - protein, 16 aa, Artificial sequence
  Synthetic peptide
KPGHKARPHIIRYKII

SEQ ID NO: 671 - protein, 19 aa, Artificial sequence
  Synthetic peptide
KIVIRIRIRLIRIRIRKIV

SEQ ID NO: 672 - protein, 19 aa, Artificial sequence
  Synthetic peptide
RIIVKIRLRIIKKIRLIKK

SEQ ID NO: 673 - protein, 19 aa, Artificial sequence
  Synthetic peptide
KIGWKLRVRIIRVKIGRLR

SEQ ID NO: 674 - protein, 25 aa, Artificial sequence
  Synthetic peptide
KIVIRIRIRLIRIRIRKIVKVKRIR

SEQ ID NO: 675 - protein, 26 aa, Artificial sequence
  Synthetic peptide
RFAVKIRLRIIKKIRLIKKIRKRVIK

SEQ ID NO: 676 - protein, 30 aa, Artificial sequence
  Synthetic peptide
KAGWKLRVRIIRVKIGRLRKIGWKKRVRIK

SEQ ID NO: 677 - protein, 16 aa, Artificial sequence
  Synthetic peptide
RIYVKPHPRYIKKIRL

SEQ ID NO: 678 - protein, 16 aa, Artificial sequence
  Synthetic peptide
KPGHKARPHIIRYKII

SEQ ID NO: 679 - protein, 19 aa, Artificial sequence
  Synthetic peptide
KIVIRIRIRLIRIRIRKIV

SEQ ID NO: 680 - protein, 19 aa, Artificial sequence
  Synthetic peptide
RIIVKIRLRIIKKIRLIKK

SEQ ID NO: 681 - protein, 16 aa, Artificial sequence
  Synthetic peptide
RIYVSKISIYIKKIRL

SEQ ID NO: 682 - protein, 19 aa, Artificial sequence
  Synthetic peptide
KIVIFTRIRLTSIRIRSIV

SEQ ID NO: 683 - protein, 16 aa, Artificial sequence
  Synthetic peptide
KPIHKARPTIIRYKMI

SEQ ID NO: 684 - protein, 25 aa, Artificial sequence
  Synthetic peptide
CKGFFALIPKIISSPLFKTLLSAVC

SEQ ID NO: 685 - protein, 26 aa, Artificial sequence
  Synthetic peptide
CKKGFFALIPKIISSPLFKTLLSAVC

SEQ ID NO: 686 - protein, 27 aa, Artificial sequence
  Synthetic peptide
CKKKGFFALIPKIISSPLFKTLLSAVC

SEQ ID NO: 687 - protein, 16 aa, Artificial sequence
  Synthetic peptide
CRIVIRIRIRLIRIRC

SEQ ID NO: 688 - protein, 18 aa, Artificial sequence
  Synthetic peptide
CKPGHKARPHIIRYKIIC

SEQ ID NO: 689 - protein, 28 aa, Artificial sequence
  Synthetic peptide
CRFAVKIRLRIIKKIRLIKKIRKRVIKC

SEQ ID NO: 690 - protein, 13 aa, Artificial sequence
  Synthetic peptide
KLLLKLLLKLLKC

SEQ ID NO: 691 - protein, 12 aa, Artificial sequence
  Synthetic peptide
KLLLKLLLKLLK

SEQ ID NO: 692 - protein, 13 aa, Artificial sequence
  Synthetic peptide
KLLLKLKLKLLKC

SEQ ID NO: 693 - protein, 12 aa, Artificial sequence
  Synthetic peptide
KLLLKLLLKLLK

SEQ ID NO: 694 - protein, 28 aa, Artificial sequence
  Synthetic peptide
HSDAVFYDNYTRLRKQMAVKKYLNSILN

SEQ ID NO: 695 - protein, 29 aa, Artificial sequence
  Synthetic peptide
  Misc_feature (1)..(1): Leu is modified to norleucine in position 1
LHSDAVFYDNYTRLRKQMAVKKYLNSILN

SEQ ID NO: 696 - protein, 11 aa, Artificial sequence
  Synthetic peptide
  Misc_feature (1)..(1): Xaa=Ala, Val, Lys, D-Lys, Orn, or nothing
  Misc_feature (2)..(2): If residue 1 is Ala, Xaa=Val or nothing; if residue 1 is Val, Xaa=Ala, Lys or nothing; if residue 1 not Ala or Val, Xaa=nothing
  Misc_feature (3)..(3): If residue 2 is Val or Ala, Xaa=Lys or nothing; if residue 2 is not Val or Ala, Xaa=nothing
  Misc_feature (4)..(4): Xaa=L-Lys, D-Lys, or Orn
  Misc_feature (5)..(5): Xaa=L-Tyr, D-Tyr, Phe, Trp, or p-amino phenylalanine
  Misc_feature (6)..(6): Xaa=Ala, D-Ala, Ile, D-Ile, Leu, D-Leu, Met, D-Met, Val, D-Val, Nva, D-Nva, Nle, or D-Nle
  Misc_feature (7)..(7): Xaa=Asn, Ser, Ile, Tyr, Leu, D-Ala, Nle, or nothing
  Misc_feature (8)..(8): If residue 7 is Asn, Xaa=Ser or nothing; if residue 7 is not Asn, Xaa=nothing
  Misc_feature (9)..(9): If residue 8 is Ser, Xaa=Ile, Tyr, or nothing; if residue 8 is not Ser, Xaa=nothing
  Misc_feature (10)..(10): If residue 9 is Ile or Tyr, Xaa=Leu; if residue 9 is not Ile or Tyr, Xaa=nothing
  Misc_feature (11)..(11): If residue 10 is Leu, Xaa=Asn; if residue 10 is not Leu, Xaa=nothing
XXXXXXXXXXX

SEQ ID NO: 697 - protein, 11 aa, Artificial sequence
  Synthetic peptide
  Misc_feature (1)..(4): Xaa=Asn, Ala, D-Ala, Ile, D-Ile, Leu, D-Leu, Met, D-Met, Val, D-Val, Nva, D-Nva, Nle, D-Nle, Tyr, Lys, or nothing
  Misc_feature (5)..(5): Xaa=Asn, Ala, D-Ala, Ile, D-Ile, Leu, D-Leu, Met, D-Met, Val, D-Val, Nva, D-Nva, Nle, D-Nle, Tyr, or nothing
  Misc_feature (6)..(6): Xaa=Ala, D-Ala, Ile, D-Ile, Leu, D-Leu, Met, D-Met, Val, D-Val, Nva, D-Nva, Nle, D-Nle, or nothing
  Misc_feature (7)..(7): Xaa=Asn or nothing
  Misc_feature (9)..(9): Xaa=Ile or Tyr
XXXXXXXSXLN

SEQ ID NO: 698 - protein, 4 aa, Artificial sequence
  Synthetic peptide
  Misc_feature (4)..(4): Xaa=any amino acid
KKYX

SEQ ID NO: 699 - protein, 4 aa, Artificial sequence
  Synthetic peptide
KKYL

SEQ ID NO: 700 - protein, 5 aa, Artificial sequence
  Synthetic peptide
NSILN

SEQ ID NO: 701 - protein, 4 aa, Artificial sequence
  Synthetic peptide
KKYL

SEQ ID NO: 702 - protein, 4 aa, Artificial sequence
  Synthetic peptide
KKYA

SEQ ID NO: 703 - protein, 6 aa, Artificial sequence
  Synthetic peptide
AVKKYL

SEQ ID NO: 704 - protein, 5 aa, Artificial sequence
  Synthetic peptide
NSILN

SEQ ID NO: 705 - protein, 4 aa, Artificial sequence
  Synthetic peptide
KKYV

SEQ ID NO: 706 - protein, 3 aa, Artificial sequence
  Synthetic peptide
  Misc_feature (2)..(3): A lauroyl moiety is between residues 2 and 3
SIN

SEQ ID NO: 707 - protein, 5 aa, Artificial sequence
  Synthetic peptide
  Misc_feature (5)..(5): Xaa=Norleucine
KKYLX

SEQ ID NO: 708 - protein, 5 aa, Artificial sequence
  Synthetic peptide
NSYLN

SEQ ID NO: 709 - protein, 5 aa, Artificial sequence
  Synthetic peptide
NSIYN

SEQ ID NO: 710 - protein, 11 aa, Artificial sequence
  Synthetic peptide
KKYLPPNSILN

SEQ ID NO: 711 - protein, 4 aa, Artificial sequence
  Synthetic peptide
  Binding (1)..(1): A lauroyl moiety is bound to residue 1
KKYL

SEQ ID NO: 712 - protein, 4 aa, Artificial sequence
  Synthetic peptide
  Binding (1)..(1): A caproyl moiety is bound to residue 1
KKYL

SEQ ID NO: 713 - protein, 3 aa, Artificial sequence
  Synthetic peptide
KYL

SEQ ID NO: 714 - protein, 4 aa, Artificial sequence
  Synthetic peptide
  Misc_feature (4)..(4): Xaa=Norleucine
KKYX

SEQ ID NO: 715 - protein, 5 aa, Artificial sequence
  Synthetic peptide
VKKYL

SEQ ID NO: 716 - protein, 6 aa, Artificial sequence
  Synthetic peptide
LNSILN

SEQ ID NO: 717 - protein, 7 aa, Artificial sequence
  Synthetic peptide
YLNSILN

SEQ ID NO: 718 - protein, 5 aa, Artificial sequence
  Synthetic peptide
KKYLN

SEQ ID NO: 719 - protein, 6 aa, Artificial sequence
  Synthetic peptide
KKYLNS

SEQ ID NO: 720 - protein, 7 aa, Artificial sequence
  Synthetic peptide
KKYLNSI

SEQ ID NO: 721 - protein, 8 aa, Artificial sequence
  Synthetic peptide
KKYLNSIL

SEQ ID NO: 722 - protein, 4 aa, Artificial sequence
  Synthetic peptide
KKYL

SEQ ID NO: 723 - protein, 5 aa, Artificial sequence
  Synthetic peptide
KKYDA

SEQ ID NO: 724 - protein, 6 aa, Artificial sequence
  Synthetic peptide
AVKKYL

SEQ ID NO: 725 - protein, 5 aa, Artificial sequence
  Synthetic peptide
NSILN

SEQ ID NO: 726 - protein, 4 aa, Artificial sequence
  Synthetic peptide
KKYV

SEQ ID NO: 727 - protein, 3 aa, Artificial sequence
  Synthetic peptide
  Misc_feature (2)..(3): A lauroyl moiety is between residues 2 and 3
SIN

SEQ ID NO: 728 - protein, 5 aa, Artificial sequence
  Synthetic peptide
NSYLN

SEQ ID NO: 729 - protein, 5 aa, Artificial sequence
  Synthetic peptide
NSIYN

SEQ ID NO: 730 - protein, 5 aa, Artificial sequence
  Synthetic peptide
  Misc_feature (5)..(5): Xaa=Norleucine
KKYLX

SEQ ID NO: 731 - protein, 11 aa, Artificial sequence
  Synthetic peptide
KKYLPPNSILN

SEQ ID NO: 732 - protein, 4 aa, Artificial sequence
  Synthetic peptide
KKYL

SEQ ID NO: 733 - protein, 5 aa, Artificial sequence
  Synthetic peptide
KKYDA

SEQ ID NO: 734 - protein, 6 aa, Artificial sequence
  Synthetic peptide
AVKKYL

SEQ ID NO: 735 - protein, 5 aa, Artificial sequence
  Synthetic peptide
NSILN

SEQ ID NO: 736 - protein, 4 aa, Artificial sequence
  Synthetic peptide
KKYV

SEQ ID NO: 737 - protein, 3 aa, Artificial sequence
  Synthetic peptide
  Misc_feature (2)..(3): A lauroyl moiety is between residues 2 and 3
SIN

SEQ ID NO: 738 - protein, 4 aa, Artificial sequence
  Synthetic peptide
  Binding (1)..(1): A lauroyl moiety is bound to residue 1
KKYL

SEQ ID NO: 739 - protein, 4 aa, Artificial sequence
  Synthetic peptide
  Binding (1)..(1): A caproyl moiety is bound to residue 1
KKYL

SEQ ID NO: 740 - protein, 3 aa, Artificial sequence
  Synthetic peptide
KYL

SEQ ID NO: 741 - protein, 3 aa, Artificial sequence
  Synthetic peptide
KYL

SEQ ID NO: 742 - protein, 4 aa, Artificial sequence
  Synthetic peptide
  Misc_feature (4)..(4): Xaa=Norleucine
KKYX

SEQ ID NO: 743 - protein, 5 aa, Artificial sequence
  Synthetic peptide
VKKYL

SEQ ID NO: 744 - protein, 6 aa, Artificial sequence
  Synthetic peptide
LNSILN

SEQ ID NO: 745 - protein, 7 aa, Artificial sequence
  Synthetic peptide
YLNSILN

SEQ ID NO: 746 - protein, 5 aa, Artificial sequence
  Synthetic peptide
  Misc_feature (5)..(5): Xaa=Norleucine
KKYLX

SEQ ID NO: 747 - protein, 5 aa, Artificial sequence
  Synthetic peptide
KKYLN

SEQ ID NO: 748 - protein, 6 aa, Artificial sequence
  Synthetic peptide
KKYLNS

SEQ ID NO: 749 - protein, 7 aa, Artificial sequence
  Synthetic peptide
KKYLNSI

SEQ ID NO: 750 - protein, 8 aa, Artificial sequence
  Synthetic peptide
KKYLNSIL

SEQ ID NO: 751 - protein, 6 aa, Artificial sequence
  Synthetic peptide
KKKYLD

SEQ ID NO: 752 - protein, 6 aa, Artificial sequence
  Synthetic peptide
CKKYLC

SEQ ID NO: 753 - protein, 6 aa, Artificial sequence
  Synthetic peptide
CKKYLK

SEQ ID NO: 754 - protein, 4 aa, Artificial sequence
  Synthetic peptide
KKYA

SEQ ID NO: 755 - protein, 8 aa, Artificial sequence
  Synthetic peptide
WWTDTGLW

SEQ ID NO: 756 - protein, 8 aa, Artificial sequence
  Synthetic peptide
WWTDDGLW

SEQ ID NO: 757 - protein, 12 aa, Artificial sequence
  Synthetic peptide
WWDTRGLWVWTI

SEQ ID NO: 758 - protein, 12 aa, Artificial sequence
  Synthetic peptide
FWGNDGIWLESG

SEQ ID NO: 759 - protein, 12 aa, Artificial sequence
  Synthetic peptide
DWDQFGLWRGAA

SEQ ID NO: 760 - protein, 12 aa, Artificial sequence
  Synthetic peptide
RWDDNGLWVVVL

SEQ ID NO: 761 - protein, 12 aa, Artificial sequence
  Synthetic peptide
SGMWSHYGIWMG

SEQ ID NO: 762 - protein, 12 aa, Artificial sequence
  Synthetic peptide
GGRWDQAGLWVA

SEQ ID NO: 763 - protein, 12 aa, Artificial sequence
  Synthetic peptide
KLWSEQGIWMGE

SEQ ID NO: 764 - protein, 10 aa, Artificial sequence
  Synthetic peptide
CWSMHGLWLC

SEQ ID NO: 765 - protein, 12 aa, Artificial sequence
  Synthetic peptide
GCWDNTGIWVPC

SEQ ID NO: 766 - protein, 10 aa, Artificial sequence
  Synthetic peptide
DWDTRGLWVY

SEQ ID NO: 767 - protein, 10 aa, Artificial sequence
  Synthetic peptide
SLWDENGAWI

SEQ ID NO: 768 - protein, 10 aa, Artificial sequence
  Synthetic peptide
KWDDRGLWMH

SEQ ID NO: 769 - protein, 10 aa, Artificial sequence
  Synthetic peptide
QAWNERGLWT

SEQ ID NO: 770 - protein, 10 aa, Artificial sequence
  Synthetic peptide
QWDTRGLWVA

SEQ ID NO: 771 - protein, 9 aa, Artificial sequence
  Synthetic peptide
WNVHGIWQE

SEQ ID NO: 772 - protein, 10 aa, Artificial sequence
  Synthetic peptide
SWDTRGLWVE

SEQ ID NO: 773 - protein, 10 aa, Artificial sequence
  Synthetic peptide
DWDTRGLWVA

SEQ ID NO: 774 - protein, 10 aa, Artificial sequence
  Synthetic peptide
SWGRDGLWIE

SEQ ID NO: 775 - protein, 10 aa, Artificial sequence
  Synthetic peptide
EWTDNGLWAL

SEQ ID NO: 776 - protein, 10 aa, Artificial sequence
  Synthetic peptide
SWDEKGLWSA

SEQ ID NO: 777 - protein, 10 aa, Artificial sequence
  Synthetic peptide
SWDSSGLWMD

SEQ ID NO: 778 - protein, 6 aa, Artificial sequence
  Synthetic peptide
TFSDLW

SEQ ID NO: 779 - protein, 12 aa, Artificial sequence
  Synthetic peptide
QETFSDLWKLLP

SEQ ID NO: 780 - protein, 12 aa, Artificial sequence
  Synthetic peptide
QPTFSDLWKLLP

SEQ ID NO: 781 - protein, 12 aa, Artificial sequence
  Synthetic peptide
QETFSDYWKLLP

SEQ ID NO: 782 - protein, 12 aa, Artificial sequence
  Synthetic peptide
QPTFSDYWKLLP

SEQ ID NO: 783 - protein, 12 aa, Artificial sequence
  Synthetic peptide
MPRFMDYWEGLN

SEQ ID NO: 784 - protein, 12 aa, Artificial sequence
  Synthetic peptide
VQNFIDYWTQQF

SEQ ID NO: 785 - protein, 12 aa, Artificial sequence
  Synthetic peptide
TGPAFTHYWATF

SEQ ID NO: 786 - protein, 15 aa, Artificial sequence
  Synthetic peptide
IDRAPTFRDHWFALV

SEQ ID NO: 787 - protein, 15 aa, Artificial sequence
  Synthetic peptide
PRPALVFADYWETLY

SEQ ID NO: 788 - protein, 15 aa, Artificial sequence
  Synthetic peptide
PAFSRFWSDLSAGAH

SEQ ID NO: 789 - protein, 15 aa, Artificial sequence
  Synthetic peptide
PAFSRFWSKLSAGAH

SEQ ID NO: 790 - protein, 10 aa, Artificial sequence
  Synthetic peptide
  Misc_feature (2)..(2): Xaa=any amino acid
  Misc_feature (4)..(4): Xaa=any amino acid
  Misc_feature (8)..(9): Xaa=any amino acid
PXFXDYWXXL

SEQ ID NO: 791 - protein, 12 aa, Artificial sequence
  Synthetic peptide
QETFSDLWKLLP

SEQ ID NO: 792 - protein, 12 aa, Artificial sequence
  Synthetic peptide
QPTFSDLWKLLP

SEQ ID NO: 793 - protein, 12 aa, Artificial sequence
  Synthetic peptide
QETFSDYWKLLP

SEQ ID NO: 794 - protein, 12 aa, Artificial sequence
  Synthetic peptide
QPTFSDYWKLLP

SEQ ID NO: 795 - protein, 13 aa, Artificial sequence
  Synthetic peptide
SCVKWGKKEFCGS

SEQ ID NO: 796 - protein, 12 aa, Artificial sequence
  Synthetic peptide
SCWKYWGKECGS

SEQ ID NO: 797 - protein, 13 aa, Artificial sequence
  Synthetic peptide
SCYEWGKLRWCGS

SEQ ID NO: 798 - protein, 13 aa, Artificial sequence
  Synthetic peptide
SCLRWGKWSNCGS

SEQ ID NO: 799 - protein, 13 aa, Artificial sequence
  Synthetic peptide
SCWRWGKYQICGS

SEQ ID NO: 800 - protein, 13 aa, Artificial sequence
  Synthetic peptide
SCVSWGALKLCGS

SEQ ID NO: 801 - protein, 13 aa, Artificial sequence
  Synthetic peptide
SCIRWGQNTFCGS

SEQ ID NO: 802 - protein, 13 aa, Artificial sequence
  Synthetic peptide
SCWQWGNLKICGS

SEQ ID NO: 803 - protein, 13 aa, Artificial sequence
  Synthetic peptide
SCVRWGQLSICGS

SEQ ID NO: 804 - protein, 21 aa, Artificial sequence
  Synthetic peptide
LKKFNARRKLKGAILTTMLAK

SEQ ID NO: 805 - protein, 18 aa, Artificial sequence
  Synthetic peptide
RRWKKNFIAVSAANRFKK

SEQ ID NO: 806 - protein, 18 aa, Artificial sequence
  Synthetic peptide
RKWQKTGHAVRAIGRLSS

SEQ ID NO: 807 - protein, 14 aa, Artificial sequence
  Synthetic peptide
INLKALAALAKKIL

SEQ ID NO: 808 - protein, 18 aa, Artificial sequence
  Synthetic peptide
KIWSILAPLGTTLVKLVA

SEQ ID NO: 809 - protein, 14 aa, Artificial sequence
  Synthetic peptide
LKKLLKLLKKLLKL

SEQ ID NO: 810 - protein, 18 aa, Artificial sequence
  Synthetic peptide
LKWKKLLKLLKKLLKKLL

SEQ ID NO: 811 - protein, 17 aa, Artificial sequence
  Synthetic peptide
AEWPSLTEIKTLSHFSV

SEQ ID NO: 812 - protein, 17 aa, Artificial sequence
  Synthetic peptide
AEWPSPTRVISTTYFGS

SEQ ID NO: 813 - protein, 17 aa, Artificial sequence
  Synthetic peptide
AELAHWPPVKTVLRSFT

SEQ ID NO: 814 - protein, 17 aa, Artificial sequence
  Synthetic peptide
AEGSWLQLLNLMKQMNN

SEQ ID NO: 815 - protein, 10 aa, Artificial sequence
  Synthetic peptide
AEWPSLTEIK

SEQ ID NO: 816 - protein, 17 aa, Artificial sequence
  Synthetic peptide
SGSGVLKRPLPILPVTR

SEQ ID NO: 817 - protein, 17 aa, Artificial sequence
  Synthetic peptide
RWLSSRPLPPLPLPPRT

SEQ ID NO: 818 - protein, 20 aa, Artificial sequence
  Synthetic peptide
GSGSYDTLALPSLPLHPMSS

SEQ ID NO: 819 - protein, 20 aa, Artificial sequence
  Synthetic peptide
GSGSYDTRALPSLPLHPMSS

SEQ ID NO: 820 - protein, 20 aa, Artificial sequence
  Synthetic peptide
GSGSSGVTMYPKLPPHWSMA

SEQ ID NO: 821 - protein, 20 aa, Artificial sequence
  Synthetic peptide
GSGSSGVRMYPKLPPHWSMA

SEQ ID NO: 822 - protein, 20 aa, Artificial sequence
  Synthetic peptide
GSGSSSMRMVPTIPGSAKHG

SEQ ID NO: 823 - protein, 6 aa, Artificial sequence
  Synthetic peptide
RNRQKT

SEQ ID NO: 824 - protein, 4 aa, Artificial sequence
  Synthetic peptide
RNRQ

SEQ ID NO: 825 - protein, 5 aa, Artificial sequence
  Synthetic peptide
RNRQK

SEQ ID NO: 826 - protein, 5 aa, Artificial sequence
  Synthetic peptide
NRQKT

SEQ ID NO: 827 - protein, 4 aa, Artificial sequence
  Synthetic peptide
RQKT

SEQ ID NO: 828 - protein, 7 aa, Artificial sequence
  Synthetic peptide
RPLPPLP

SEQ ID NO: 829 - protein, 7 aa, Artificial sequence
  Synthetic peptide
RELPPLP

SEQ ID NO: 830 - protein, 7 aa, Artificial sequence
  Synthetic peptide
SPLPPLP

SEQ ID NO: 831 - protein, 7 aa, Artificial sequence
  Synthetic peptide
GPLPPLP

SEQ ID NO: 832 - protein, 7 aa, Artificial sequence
  Synthetic peptide
RPLPIPP

SEQ ID NO: 833 - protein, 7 aa, Artificial sequence
  Synthetic peptide
RPLPIPP

SEQ ID NO: 834 - protein, 7 aa, Artificial sequence
  Synthetic peptide
RRLPPTP

SEQ ID NO: 835 - protein, 7 aa, Artificial sequence
  Synthetic peptide
RQLPPTP

SEQ ID NO: 836 - protein, 7 aa, Artificial sequence
  Synthetic peptide
RPLPSRP

SEQ ID NO: 837 - protein, 7 aa, Artificial sequence
  Synthetic peptide
RPLPTRP

SEQ ID NO: 838 - protein, 7 aa, Artificial sequence
  Synthetic peptide
SRLPPLP

SEQ ID NO: 839 - protein, 7 aa, Artificial sequence
  Synthetic peptide
RALPSPP

SEQ ID NO: 840 - protein, 7 aa, Artificial sequence
  Synthetic peptide
RRLPRTP

SEQ ID NO: 841 - protein, 7 aa, Artificial sequence
  Synthetic peptide
RPVPPIT

SEQ ID NO: 842 - protein, 7 aa, Artificial sequence
  Synthetic peptide
ILAPPVP

SEQ ID NO: 843 - protein, 7 aa, Artificial sequence
  Synthetic peptide
RPLPMLP

SEQ ID NO: 844 - protein, 7 aa, Artificial sequence
  Synthetic peptide
RPLPILP

SEQ ID NO: 845 - protein, 7 aa, Artificial sequence
  Synthetic peptide
RPLPSLP

SEQ ID NO: 846 - protein, 7 aa, Artificial sequence
  Synthetic peptide
RPLPSLP

SEQ ID NO: 847 - protein, 7 aa, Artificial sequence
  Synthetic peptide
RPLPMIP

SEQ ID NO: 848 - protein, 7 aa, Artificial sequence
  Synthetic peptide
RPLPLIP

SEQ ID NO: 849 - protein, 7 aa, Artificial sequence
  Synthetic peptide
RPLPPTP

SEQ ID NO: 850 - protein, 7 aa, Artificial sequence
  Synthetic peptide
RSLPPLP

SEQ ID NO: 851 - protein, 7 aa, Artificial sequence
  Synthetic peptide
RPQPPPP

SEQ ID NO: 852 - protein, 7 aa, Artificial sequence
  Synthetic peptide
RQLPIPP

SEQ ID NO: 853 - protein, 12 aa, Artificial sequence
  Synthetic peptide
  Misc_feature (1)..(3): Xaa=any amino acid
  Misc_feature (11)..(11): Xaa=any amino acid
XXXRPLPPLPXP

SEQ ID NO: 854 - protein, 12 aa, Artificial sequence
  Synthetic peptide
  Misc_feature (1)..(3): Xaa=any amino acid
  Misc_feature (11)..(12): Xaa=any amino acid
XXXRPLPPIPXX

SEQ ID NO: 855 - protein, 12 aa, Artificial sequence
  Synthetic peptide
  Misc_feature (1)..(3): Xaa=any amino acid
  Misc_feature (11)..(12): Xaa=any amino acid
XXXRPLPPLPXX

SEQ ID NO: 856 - protein, 12 aa, Artificial sequence
  Synthetic peptide
  Misc_feature (2)..(3): Xaa=any amino acid
  Misc_feature (11)..(11): Xaa=any amino acid
RXXRPLPPLPXP

SEQ ID NO: 857 - protein, 12 aa, Artificial sequence
  Synthetic peptide
  Misc_feature (2)..(3): Xaa=any amino acid
RXXRPLPPLPPP

SEQ ID NO: 858 - protein, 12 aa, Artificial sequence
  Synthetic peptide
  Misc_feature (11)..(12): Xaa=any amino acid
PPPYPPPPIPXX

SEQ ID NO: 859 - protein, 12 aa, Artificial sequence
  Synthetic peptide
  Misc_feature (11)..(12): Xaa=any amino acid
PPPYPPPPVPXX

SEQ ID NO: 860 - protein, 10 aa, Artificial sequence
  Synthetic peptide
  Misc_feature (2)..(3): Xaa=any amino acid
  Misc_feature (8)..(8): Xaa=any amino acid
  Misc_feature (9)..(9): Xaa=Ile, Val, Leu, Ala, or Pro
LXXRPLPXXP

SEQ ID NO: 861 - protein, 10 aa, Artificial sequence
  Synthetic peptide
  Misc_feature (1)..(1): Xaa=Ile, Val, Leu, Ala, or Pro
  Misc_feature (2)..(3): Xaa=any amino acid
  Misc_feature (8)..(8): Xaa=any amino acid
XXXRPLPXLP

SEQ ID NO: 862 - protein, 10 aa, Artificial sequence
  Synthetic peptide
  Misc_feature (3)..(3): Xaa=any amino acid
  Misc_feature (4)..(4): Xaa=Phe, Tyr, or Trp
  Misc_feature (5)..(5): Xaa=any amino acid
  Misc_feature (9)..(9): Xaa=Ile, Val, Leu, Ala, or Pro
PPXXXPPPXP

SEQ ID NO: 863 - protein, 11 aa, Artificial sequence
  Synthetic peptide
  Misc_feature (1)..(1): Xaa=His, Lys, or Arg
  Misc_feature (4)..(4): Xaa=Ile, Val, Leu, Ala, or Pro
  Misc_feature (6)..(6): Xaa=any amino acid
  Misc_feature (9)..(9): Xaa=any amino acid
XPPXPXKPXWL

SEQ ID NO: 864 - protein, 11 aa, Artificial sequence
  Synthetic peptide
  Misc_feature (3)..(3): Xaa=any amino acid
  Misc_feature (4)..(4): Xaa=Ile, Val, Leu, Ala, or Pro
  Misc_feature (6)..(6): Xaa=Ile, Val, Leu, Ala, or Pro
  Misc_feature (8)..(8): Xaa=His, Lys, or Arg
  Misc_feature (10)..(10): Xaa=any amino acid
RPXXPXRXSXP

SEQ ID NO: 865 - protein, 11 aa, Artificial sequence
  Synthetic peptide
  Misc_feature (8)..(9): Xaa=any amino acid
PPVPPRPXXTL

SEQ ID NO: 866 - protein, 7 aa, Artificial sequence
  Synthetic peptide
  Misc_feature (1)..(1): Xaa=Ile, Val, Leu, Ala, or Pro
  Misc_feature (3)..(3): Xaa=Ile, Val, Leu, Ala, or Pro
  Misc_feature (6)..(6): Xaa=Ile, Val, Leu, Ala, or Pro
XPXLPXK

SEQ ID NO: 867 - protein, 10 aa, Artificial sequence
  Synthetic peptide
  Misc_feature (1)..(1): Xaa=His, Lys, or Arg
  Misc_feature (2)..(2): Xaa=Phe, Tyr, or Trp
  Misc_feature (4)..(4): Xaa=any amino acid
  Misc_feature (8)..(8): Xaa=any amino acid
XXDXPLPXLP

SEQ ID NO: 868 - protein, 17 aa, Artificial sequence
  Synthetic peptide
  Misc_feature (1)..(1): Xaa=Asp, Arg, Met, Pro, or Cys
  Misc_feature (2)..(2): If residue 1 is Asp, Xaa=Arg; if residue 1 is Arg, Xaa=Met; if residue 1 is Met, Xaa=Pro; if residue 1 is Pro, Xaa=Cys; if residue 1 is Cys, Xaa=nothing
  Misc_feature (3)..(3): If residue 1 is Asp, Xaa=Met; if residue 1 is Arg, Xaa=Pro; if residue 1 is Met, Xaa=Cys; if residue 1 is Pro or Cys, Xaa=nothing
  Misc_feature (4)..(4): If residue 1 is Asp, Xaa=Pro; if residue 1 is Arg, Xaa=Cys; if residue 1 is Met, Pro, or Cys, Xaa=nothing
  Misc_feature (5)..(5): If residue 1 is Asp, Xaa=Cys; if residue 1 is Arg, Met, Pro, or Cys, Xaa=nothing
  Misc_feature (6)..(6): Xaa=Arg or Lys
  Misc_feature (14)..(14): Xaa=Ser or Thr
  Misc_feature (16)..(16): Xaa=Cys
  Misc_feature (17)..(17): Xaa=Lys or nothing
XXXXXXNFFWKTFXSXX

SEQ ID NO: 869 - protein, 17 aa, Artificial sequence
  Synthetic peptide
DRMPCRNFFWKTFSSCK

SEQ ID NO: 870 - protein, 15 aa, Artificial sequence
  Synthetic peptide
MPCRNFFWKTFSSCK

SEQ ID NO: 871 - protein, 13 aa, Artificial sequence
  Synthetic peptide
CRNFFWKTFSSCK

SEQ ID NO: 872 - protein, 16 aa, Artificial sequence
  Synthetic peptide
DRMPCRNFFWKTFSSC

SEQ ID NO: 873 - protein, 14 aa, Artificial sequence
  Synthetic peptide
MPCRNFFWKTFSSC

SEQ ID NO: 874 - protein, 12 aa, Artificial sequence
  Synthetic peptide
CRNFFWKTFSSC

SEQ ID NO: 875 - protein, 16 aa, Artificial sequence
  Synthetic peptide
DRMPCKNFFWKTFSSC

SEQ ID NO: 876 - protein, 15 aa, Artificial sequence
  Synthetic peptide
MPCKNFFWKTFSSCK

SEQ ID NO: 877 - protein, 13 aa, Artificial sequence
  Synthetic peptide
CKNFFWKTFSSCK

SEQ ID NO: 878 - protein, 16 aa, Artificial sequence
  Synthetic peptide
DRMPCKNFFWKTFSSC

SEQ ID NO: 879 - protein, 14 aa, Artificial sequence
  Synthetic peptide
MPCKNFFWKTFSSC

SEQ ID NO: 880 - protein, 12 aa, Artificial sequence
  Synthetic peptide
CKNFFWKTFSSC

SEQ ID NO: 881 - protein, 17 aa, Artificial sequence
  Synthetic peptide
DRMPCRNFFWKTFTSCK

SEQ ID NO: 882 - protein, 15 aa, Artificial sequence
  Synthetic peptide
MPCRNFFWKTFTSCK

SEQ ID NO: 883 - protein, 13 aa, Artificial sequence
  Synthetic peptide
CRNFFWKTFTSCK

SEQ ID NO: 884 - protein, 16 aa, Artificial sequence
  Synthetic peptide
DRMPCRNFFWKTFTSC

SEQ ID NO: 885 - protein, 14 aa, Artificial sequence
  Synthetic peptide
MPCRNFFWKTFTSC

SEQ ID NO: 886 - protein, 12 aa, Artificial sequence
  Synthetic peptide
CRNFFWKTFTSC

SEQ ID NO: 887 - protein, 17 aa, Artificial sequence
  Synthetic peptide
DRMPCKNFFWKTFTSCK

SEQ ID NO: 888 - protein, 15 aa, Artificial sequence
  Synthetic peptide
MPCKNFFWKTFTSCK

SEQ ID NO: 889 - protein, 13 aa, Artificial sequence
  Synthetic peptide
CKNFFWKTFTSCK

SEQ ID NO: 890 - protein, 16 aa, Artificial sequence
  Synthetic peptide
DRMPCKNFFWKTFTSC

SEQ ID NO: 891 - protein, 14 aa, Artificial sequence
  Synthetic peptide
MPCKNFFWKTFTSC

SEQ ID NO: 892 - protein, 12 aa, Artificial sequence
  Synthetic peptide
CKNFFWKTFTSC

SEQ ID NO: 893 - protein, 17 aa, Artificial sequence
  Synthetic peptide
AEPMPHSLNFSQYLWYT

SEQ ID NO: 894 - protein, 17 aa, Artificial sequence
  Synthetic peptide
AEHTYSSLWDTYSPLAF

SEQ ID NO: 895 - protein, 17 aa, Artificial sequence
  Synthetic peptide
AELDLWMRHYPLSFSNR

SEQ ID NO: 896 - protein, 17 aa, Artificial sequence
  Synthetic peptide
AESSLWTRYAWPSMPSY

SEQ ID NO: 897 - protein, 17 aa, Artificial sequence
  Synthetic peptide
AEWHPGLSFGSYLWSKT

SEQ ID NO: 898 - protein, 17 aa, Artificial sequence
  Synthetic peptide
AEPALLNWSFFFNPGLH

SEQ ID NO: 899 - protein, 17 aa, Artificial sequence
  Synthetic peptide
AEWSFYNLHLPEPQTIF

SEQ ID NO: 900 - protein, 17 aa, Artificial sequence
  Synthetic peptide
AEPLDLWSLYSLPPLAM

SEQ ID NO: 901 - protein, 17 aa, Artificial sequence
  Synthetic peptide
AEPTLWQLYQFPLRLSG

SEQ ID NO: 902 - protein, 17 aa, Artificial sequence
  Synthetic peptide
AEISFSELMWLRSTPAF

SEQ ID NO: 903 - protein, 17 aa, Artificial sequence
  Synthetic peptide
AELSEADLWTTWFGMGS

SEQ ID NO: 904 - protein, 17 aa, Artificial sequence
  Synthetic peptide
AESSLWRIFSPSALMMS

SEQ ID NO: 905 - protein, 17 aa, Artificial sequence
  Synthetic peptide
AESLPTLTSILWGKESV

SEQ ID NO: 906 - protein, 17 aa, Artificial sequence
  Synthetic peptide
AETLFMDLWHDKHILLT

SEQ ID NO: 907 - protein, 17 aa, Artificial sequence
  Synthetic peptide
AEILNFPLWHEPLWSTE

SEQ ID NO: 908 - protein, 17 aa, Artificial sequence
  Synthetic peptide
AESQTGTLNTLFWNTLR

SEQ ID NO: 909 - protein, 17 aa, Artificial sequence
  Synthetic peptide
AEPVYQYELDSYLRSYY

SEQ ID NO: 910 - protein, 17 aa, Artificial sequence
  Synthetic peptide
AELDLSTFYDIQYLLRT

SEQ ID NO: 911 - protein, 17 aa, Artificial sequence
  Synthetic peptide
AEFFKLGPNGYVYLHSA

SEQ ID NO: 912 - protein, 11 aa, Artificial sequence
  Synthetic peptide
  Misc_feature (4)..(6): Xaa=any amino acid
FKLXXXGYVYL

SEQ ID NO: 913 - protein, 17 aa, Artificial sequence
  Synthetic peptide
AESTYHHLSLGYMYTLN

SEQ ID NO: 914 - protein, 11 aa, Artificial sequence
  Synthetic peptide
  Misc_feature (3)..(3): Xaa=any amino acid
  Misc_feature (5)..(6): Xaa=any amino acid
YHXLXXGYMYT

SEQ ID NO: 915 - protein, 19 aa, Artificial sequence
  Synthetic peptide
VEPNCDIHVMWEWECFERL

SEQ ID NO: 916 - protein, 18 aa, Artificial sequence
  Synthetic peptide
GERWCFDGPLTWVCGEES

SEQ ID NO: 917 - protein, 20 aa, Artificial sequence
  Synthetic peptide
RGWVEICVADDNGMCVTEAQ

SEQ ID NO: 918 - protein, 19 aa, Artificial sequence
  Synthetic peptide
GWDECDVARMWEWECFAGV

SEQ ID NO: 919 - protein, 18 aa, Artificial sequence
  Synthetic peptide
GERWCFDGPRAWVCGWEI

SEQ ID NO: 920 - protein, 18 aa, Artificial sequence
  Synthetic peptide
EELWCFDGPRAWVCGYVK

SEQ ID NO: 921 - protein, 20 aa, Artificial sequence
  Synthetic peptide
RGWVEICAADDYGRCLTEAQ

SEQ ID NO: 922 - protein, 16 aa, Artificial sequence
  Synthetic peptide
RGWVEICESDVWGRCL

SEQ ID NO: 923 - protein, 16 aa, Artificial sequence
  Synthetic peptide
RGWVEICESDVWGRCL

SEQ ID NO: 924 - protein, 19 aa, Artificial sequence
  Synthetic peptide
GGNECDIARMWEWECFERL

SEQ ID NO: 925 - protein, 16 aa, Artificial sequence
  Synthetic peptide
RGWVEICAADDYGRCL

SEQ ID NO: 926 - protein, 10 aa, Artificial sequence
  Synthetic peptide
CTTHWGFTLC

SEQ ID NO: 927 - protein, 8 aa, Artificial sequence
  Synthetic peptide
  Misc_feature (6)..(6): Xaa= any amino acid
CLRSGXGC

SEQ ID NO: 928 - protein, 10 aa, Artificial sequence
  Synthetic peptide
  Misc_feature (2)..(3): Xaa= any amino acid
  Misc_feature (8)..(9): Xaa= any amino acid
CXXHWGFXXC

SEQ ID NO: 929 - protein, 5 aa, Artificial sequence
  Synthetic peptide
  Misc_feature (2)..(2): Xaa= any amino acid
  Misc_feature (4)..(4): Xaa= any amino acid
CXPXC

SEQ ID NO: 930 - protein, 10 aa, Artificial sequence
  Synthetic peptide
CRRHWGFEFC

SEQ ID NO: 931 - protein, 10 aa, Artificial sequence
  Synthetic peptide
STTHWGFTLS

SEQ ID NO: 932 - protein, 10 aa, Artificial sequence
  Synthetic peptide
CSLHWGFWWC

SEQ ID NO: 933 - protein, 15 aa, Artificial sequence
  Synthetic peptide
GFVCSGIFAVGVGRC

SEQ ID NO: 934 - protein, 15 aa, Artificial sequence
  Synthetic peptide
APGVRLGCAVLGRYC

SEQ ID NO: 935 - protein, 6 aa, Artificial sequence
  Synthetic peptide
LLGRMK

SEQ ID NO: 936 - protein, 27 aa, Artificial sequence
  Synthetic peptide
ICVVQDWGHHRCTAGHMANLTSHASAI

SEQ ID NO: 937 - protein, 13 aa, Artificial sequence
  Synthetic peptide
ICVVQDWGHHRCT

SEQ ID NO: 938 - protein, 11 aa, Artificial sequence
  Synthetic peptide
CVVQDWGHHAC

SEQ ID NO: 939 - protein, 27 aa, Artificial sequence
  Synthetic peptide
STGGFDDVYDWARGVSSALTTTLVATR

SEQ ID NO: 940 - protein, 27 aa, Artificial sequence
  Synthetic peptide
STGGFDDVYDWARRVSSALTTTLVATR

SEQ ID NO: 941 - protein, 30 aa, Artificial sequence
  Synthetic peptide
SRGVNFSEWLYDMSAAMKEASNVFPSRRSR

SEQ ID NO: 942 - protein, 30 aa, Artificial sequence
  Synthetic peptide
SSQNWDMEAGVEDLTAAMLGLLSTIHSSSR

SEQ ID NO: 943 - protein, 31 aa, Artificial sequence
  Synthetic peptide
SSPSLYTQFLVNYESAATRIQDLLIASRPSR

SEQ ID NO: 944 - protein, 31 aa, Artificial sequence
  Synthetic peptide
SSTGWVDLLGALQRAADATRTSIPPSLQNSR

SEQ ID NO: 945 - protein, 18 aa, Artificial sequence
  Synthetic peptide
DVYTKKELIECARRVSEK

SEQ ID NO: 946 - protein, 22 aa, Artificial sequence
  Synthetic peptide
EKGSYYPGSGIAQFHIDYNNVS

SEQ ID NO: 947 - protein, 22 aa, Artificial sequence
  Synthetic peptide
SGIAQFHIDYNNVSSAEGWHVN

SEQ ID NO: 948 - protein, 34 aa, Artificial sequence
  Synthetic peptide
LVTVEKGSYYPGSGIAQFHIDYNNVSSAEGWHVN

SEQ ID NO: 949 - protein, 14 aa, Artificial sequence
  Synthetic peptide
SGIAQFHIDYNNVS

SEQ ID NO: 950 - protein, 6 aa, Artificial sequence
  Synthetic peptide
LLGRMK

SEQ ID NO: 951 - protein, 8 aa, Artificial sequence
  Synthetic peptide
ALLGRMKG

SEQ ID NO: 952 - protein, 6 aa, Artificial sequence
  Synthetic peptide
LDPAFR

SEQ ID NO: 953 - protein, 7 aa, Artificial sequence
  Synthetic peptide
  Misc_feature (2)..(3): Xaa= any amino acid
CXXRGDC

SEQ ID NO: 954 - protein, 7 aa, Artificial sequence
  Synthetic peptide
RPLPPLP

SEQ ID NO: 955 - protein, 6 aa, Artificial sequence
  Synthetic peptide
PPVPPR

SEQ ID NO: 956 - protein, 11 aa, Artificial sequence
  Synthetic peptide
  Misc_feature (1)..(1): Xaa= any amino acid
  Misc_feature (3)..(3): Xaa= any amino acid
  Misc_feature (5)..(5): Xaa= any amino acid
  Misc_feature (7)..(8): Xaa= any amino acid
  Misc_feature (10)..(11): Xaa= any amino acid
XFXDXWXXLXX

SEQ ID NO: 957 - protein, 20 aa, Artificial sequence
  Synthetic peptide
KACRRLFGPVDSEQLSRDCD

SEQ ID NO: 958 - protein, 20 aa, Artificial sequence
  Synthetic peptide
RERWNFDFVTETPLEGDFAW

SEQ ID NO: 959 - protein, 20 aa, Artificial sequence
  Synthetic peptide
KRRQTSMTDFYHSKRRLIFS

SEQ ID NO: 960 - protein, 20 aa, Artificial sequence
  Synthetic peptide
TSMTDFYHSKRRLIFSKRKP

SEQ ID NO: 961 - protein, 5 aa, Artificial sequence
  Synthetic peptide
RRLIF

SEQ ID NO: 962 - protein, 36 aa, Artificial sequence [sequence omitted]

SEQ ID NO: 963 - protein, 24 aa, Artificial sequence
  Synthetic peptide
KRRLIFSKRQIKIWFQNRRMKWKK

SEQ ID NO: 964 - protein, 24 aa, Artificial sequence
  Synthetic peptide
NQGRHFCGALIHARFVMTAASCFQ

SEQ ID NO: 965 - protein, 20 aa, Artificial sequence
  Synthetic peptide
RHFCGGALIHARFVMTAASC

SEQ ID NO: 966 - protein, 27 aa, Artificial sequence
  Synthetic peptide
GTRCQVAGWGSQRSGGRLSRFPRFVNV

SEQ ID NO: 967 - protein, 15 aa, Artificial sequence
  Synthetic peptide
WHWRHRIPLQLAAGR

SEQ ID NO: 968 - protein, 6 aa, Artificial sequence
  Synthetic peptide
LKTPRV

SEQ ID NO: 969 - protein, 8 aa, Artificial sequence
  Synthetic peptide
NTLKTPRV

SEQ ID NO: 970 - protein, 11 aa, Artificial sequence
  Synthetic peptide
NTLKTPRVGGC

SEQ ID NO: 971 - protein, 6 aa, Artificial sequence
  Synthetic peptide
KDKATF

SEQ ID NO: 972 - protein, 10 aa, Artificial sequence
  Synthetic peptide
KDKATFGCHD

SEQ ID NO: 973 - protein, 12 aa, Artificial sequence
  Synthetic peptide
KDKATFGCHDGC

SEQ ID NO: 974 - protein, 6 aa, Artificial sequence
  Synthetic peptide
TLRVYK

SEQ ID NO: 975 - protein, 9 aa, Artificial sequence
  Synthetic peptide
ATLRVYKGG

SEQ ID NO: 976 - protein, 10 aa, Artificial sequence
  Synthetic peptide
CATLRVYKGG

SEQ ID NO: 977 - protein, 14 aa, Artificial sequence
  Synthetic peptide
INLKALAALAKKIL

SEQ ID NO: 978 - protein, 12 aa, Artificial sequence
  Synthetic peptide
GWTLNSAGYLLG

SEQ ID NO: 979 - protein, 27 aa, Artificial sequence
  Synthetic peptide
GWTLNSAGYLLGKINLKALAALAKKIL

SEQ ID NO: 980 - protein, 7 aa, Artificial sequence
  Synthetic peptide
CVHAYRS

SEQ ID NO: 981 - protein, 7 aa, Artificial sequence
  Synthetic peptide
CVHAYRA

SEQ ID NO: 982 - protein, 7 aa, Artificial sequence
  Synthetic peptide
CVHAPRS

SEQ ID NO: 983 - protein, 7 aa, Artificial sequence
  Synthetic peptide
CVHAPRA

SEQ ID NO: 984 - protein, 7 aa, Artificial sequence
  Synthetic peptide
CVHSYRS

SEQ ID NO: 985 - protein, 7 aa, Artificial sequence
  Synthetic peptide
CVHSYRA

SEQ ID NO: 986 - protein, 7 aa, Artificial sequence
  Synthetic peptide
CVHSPRS

SEQ ID NO: 987 - protein, 7 aa, Artificial sequence
  Synthetic peptide
CVHSPRA

SEQ ID NO: 988 - protein, 7 aa, Artificial sequence
  Synthetic peptide
CVHTYRS

SEQ ID NO: 989 - protein, 7 aa, Artificial sequence
  Synthetic peptide
CVHTYRA

SEQ ID NO: 990 - protein, 7 aa, Artificial sequence
  Synthetic peptide
CVHTPRS

SEQ ID NO: 991 - protein, 7 aa, Artificial sequence
  Synthetic peptide
CVHTPRA

SEQ ID NO: 992 - protein, 6 aa, Artificial sequence
  Synthetic peptide
HWAWFK

SEQ ID NO: 993 - protein, 32 aa, Artificial sequence
  Synthetic peptide
IEGPTLRQWLAARAGPNGIEGPTLRQWLAARA

SEQ ID NO: 994 - protein, 36 aa, Artificial sequence
  Synthetic peptide
IEGPTLRQCLAARAGGGGGGGGIEGPTLRQCLAARA

SEQ ID NO: 995 - protein, 36 aa, Artificial sequence; identical to SEQ ID NO: 994
  Synthetic peptide

SEQ ID NO: 996 - protein, 36 aa, Artificial sequence
  Synthetic peptide
IEGPTLRQALAARAGGGGGGGGIEGPTLRQALAARA

SEQ ID NO: 997 - protein, 36 aa, Artificial sequence
  Synthetic peptide
IEGPTLRQWLAARAGGGKGGGGIEGPTLRQWLAARA

SEQ ID NO: 998 - protein, 36 aa, Artificial sequence; identical to SEQ ID NO: 997
  Synthetic peptide

SEQ ID NO: 999 - protein, 36 aa, Artificial sequence
  Synthetic peptide
IEGPTLRQWLAARAGGGCGGGGIEGPTLRQWLAARA

SEQ ID NO: 1000 - protein, 36 aa, Artificial sequence; identical to SEQ ID NO: 997
  Synthetic peptide

SEQ ID NO: 1001 - protein, 36 aa, Artificial sequence; identical to SEQ ID NO: 999
  Synthetic peptide

SEQ ID NO: 1002 - protein, 36 aa, Artificial sequence
  Synthetic peptide
IEGPTLRQWLAARAGGGNGSGGIEGPTLRQWLAARA

SEQ ID NO: 1003 - protein, 36 aa, Artificial sequence; identical to SEQ ID NO: 999
  Synthetic peptide

SEQ ID NO: 1004 - protein, 36 aa, Artificial sequence
  Synthetic peptide
IEGPTLRQWLAARAGGGGGGGGIEGPTLRQWLAARA

SEQ ID NO: 1005 - protein, 32 aa, Artificial sequence; identical to SEQ ID NO: 993
  Synthetic peptide

SEQ ID NO: 1006 - protein, 32 aa, Artificial sequence; identical to SEQ ID NO: 993
  Synthetic peptide

SEQ ID NO: 1007 - protein, 36 aa, Artificial sequence; identical to SEQ ID NO: 1004
  Synthetic peptide

SEQ ID NO: 1008 - protein, 34 aa, Artificial sequence
  Synthetic peptide
GGIEGPTLRQWLAARAGPNGIEGPTLRQWLAARA

SEQ ID NO: 1009 - protein, 36 aa, Artificial sequence; identical to SEQ ID NO: 1004
  Synthetic peptide

SEQ ID NO: 1010 - protein, 36 aa, Artificial sequence; identical to SEQ ID NO: 994
  Synthetic peptide

SEQ ID NO: 1011 - protein, 36 aa, Artificial sequence; identical to SEQ ID NO: 994
  Synthetic peptide

SEQ ID NO: 1012 - protein, 36 aa, Artificial sequence; identical to SEQ ID NO: 996
  Synthetic peptide

SEQ ID NO: 1013 - protein, 36 aa, Artificial sequence; identical to SEQ ID NO: 997
  Synthetic peptide

SEQ ID NO: 1014 - protein, 36 aa, Artificial sequence; identical to SEQ ID NO: 999
  Synthetic peptide

SEQ ID NO: 1015 - protein, 36 aa, Artificial sequence; identical to SEQ ID NO: 1002
  Synthetic peptide

SEQ ID NO: 1016 - protein, 36 aa, Artificial sequence; identical to SEQ ID NO: 999
  Synthetic peptide

SEQ ID NO: 1017 - protein, 41 aa, Artificial sequence; identical to SEQ ID NO: 1
  Synthetic peptide

SEQ ID NO: 1018 - protein, 8 aa, Artificial sequence
  Synthetic peptide
GGGKGGGG

SEQ ID NO: 1019 - protein, 8 aa, Artificial sequence
  Synthetic peptide
GGGNGSGG

SEQ ID NO: 1020 - protein, 8 aa, Artificial sequence
  Synthetic peptide
GGGCGGGG

SEQ ID NO: 1021 - protein, 5 aa, Artificial sequence
  Synthetic peptide
GPNGG

SEQ ID NO: 1022 - protein, 29 aa, Artificial sequence
  Synthetic peptide
CCGGGTAAAGGTGGAGGTGGTGGTATCGA

SEQ ID NO: 1023 - protein, 18 aa, Artificial sequence
  Synthetic peptide
CTAGTTATTGCTCAGCGG

SEQ ID NO: 1024 - protein, 29 aa, Artificial sequence
  Synthetic peptide
CCGGGTAAAGGTGGAGGTGGTGGTATCGA

SEQ ID NO: 1025 - protein, 30 aa, Artificial sequence
  Synthetic peptide
CCACCTCCACCTTTACCCGGAGAGTGGGAG

SEQ ID NO: 1026 - protein, 25 aa, Artificial sequence
  Synthetic peptide
CGTACAGGTTTACGCAAGAAAATGG

SEQ ID NO: 1027 - protein, 30 aa, Artificial sequence; identical to SEQ ID NO: 1025
  Synthetic peptide

SEQ ID NO: 1028 - protein, 25 aa, Artificial sequence
  Synthetic peptide
CGTACAGGTTTACGCAAGAAAATGG

SEQ ID NO: 1029 - protein, 30 aa, Artificial sequence; identical to SEQ ID NO: 1025
  Synthetic peptide

SEQ ID NO: 1030 - protein, 25 aa, Artificial sequence
  Synthetic peptide
CGTACAGGTTTACGCAAGAAAATGG

SEQ ID NO: 1031 - protein, 18 aa, Artificial sequence
  Synthetic peptide
CTAGTTATTGCTCAGCGG

SEQ ID NO: 1032 - protein, 847 aa, Artificial sequence
  Synthetic peptide
GATTTGATTCTAGATTTGTTTTAACTAATTAAAGGAGGAATAACATATGGTCGACGGTTGTAAGCCATGCATTTGTACAGTCCCAGAAGTATCATCTGTCTTCATCTTCCCCCCAAAGCCCAAGGATGTGCTCACCATTACTCTGACTCCTAAGGTCACGTGTGTTGTGGTAGACATCAGCAAGGATGATCCCGAGGTCCAGTTCAGCTGGTTTGTAGATGATGTGGAGGTGCACACAGCTCAGACGCAACCCCGGGAGGAGCAGTTCAACAGCACTTTCCGCTCAGTCAGTGAACTTCCCATCATGCACCAGGACTGGCTCAATGGCAAGGAGTTCAAATGCAGGGTCAACAGTGCAGCTTTCCCTGCCCCCATCGAGAAAACCATCTCCAAAACCAAAGGCAGACCGAAGGCTCCACAGGTGTACACCATTCCACCTCCCAAGGAGCAGATGGCCAAGGATAAAGTCAGTCTGACCTGCATGATAACAGACTTCTTCCCTGAAGACATTACTGTGGAGTGGCAGTGGAATGGGCAGCCAGCGGAGAACTACAAGAACACTCAGCCCATCATGGACACAGATGGCTCTTACTTCGTCTACAGCAAGCTCAATGTGCAGAAGAGCAACTGGGAGGCAGGAAATACTTTCACCTGCTCTGTGTTACATGAGGGCCTGCACAACCACCATACTGAGAAGAGCCTCTCCCACTCTCCGGGTAAAGGTGGAGGTGGTGGTATCGAAGGTCCGACTCTGCGTCAGTGGCTGGCTGCTCGTGCTGGTGGTGGAGGTGGCGGCGGAGGTATTGAGGGCCCAACCCTTCGCCAATGGCTTGCAGCACGCGCATAA

SEQ ID NO: 1033 - protein, 266 aa, Artificial sequence
  Synthetic peptide
MVDGCKPCICTVPEVSSVFIFPPKPKDVLTITLTPKVTCVVVDISKDDPEVQFSWFVDDVEVHTAQTQPREEQFNSTFRSVSELPIMHQDWLNGKEFKCRVNSAAFPAPIEKTISKTKGRPKAPQVYTIPPPKEQMAKDKVSLTCMITDFFPEDITVEWQWNGQPAENYKNTQPIMDTDGSYFVYSKLNVQKSNWEAGNTFTCSVLHEGLHNHHTEKSLSHSPGKGGGGGIEGPTLRQWLAARAGGGGGGGGIEGPTLRQWLAARA

SEQ ID NO: 1034 - protein, 847 aa, Artificial sequence; identical to SEQ ID NO: 1032
  Synthetic peptide

SEQ ID NO: 1035 - protein, 266 aa, Artificial sequence; identical to SEQ ID NO: 1033
  Synthetic peptide

SEQ ID NO: 1036 - protein, 14 aa, Artificial sequence
  Synthetic peptide
KDKCKMWHWMCKPP

SEQ ID NO: 1037 - protein, 14 aa, Artificial sequence
  Synthetic peptide
KDLCAMWHWMCKPP

SEQ ID NO: 1038 - protein, 14 aa, Artificial sequence
  Synthetic peptide
KDLCKMWKWMCKPP

SEQ ID NO: 1039 - protein, 14 aa, Artificial sequence
  Synthetic peptide
KDLCKMWHWMCKPK

SEQ ID NO: 1040 - protein, 14 aa, Artificial sequence
  Synthetic peptide
WYPCYEFHFWCYDL

SEQ ID NO: 1041 - protein, 14 aa, Artificial sequence
  Synthetic peptide
WYPCYEGHFWCYDL

SEQ ID NO: 1042 - protein, 14 aa, Artificial sequence
  Synthetic peptide
IFGCKWWDVQCYQF

SEQ ID NO: 1043 - protein, 14 aa, Artificial sequence
  Synthetic peptide
IFGCKWWDVDCYQF

SEQ ID NO: 1044 - protein, 14 aa, Artificial sequence
  Synthetic peptide
ADWCVSPNWFCMVM

SEQ ID NO: 1045 - protein, 14 aa, Artificial sequence
  Synthetic peptide
HKFCPWWALFCWDF

SEQ ID NO: 1046 - protein, 14 aa, Artificial sequence
  Synthetic peptide
KDLCKMWHWMCKPP

SEQ ID NO: 1047 - protein, 14 aa, Artificial sequence
  Synthetic peptide
IDKCAIWGWMCPPL

SEQ ID NO: 1048 - protein, 14 aa, Artificial sequence
  Synthetic peptide
WYPCGEFGMWCLNV

SEQ ID NO: 1049 - protein, 11 aa, Artificial sequence
  Synthetic peptide
WFTCLWNCDNE

SEQ ID NO: 1050 - protein, 14 aa, Artificial sequence
  Synthetic peptide
HTPCPWFAPLCVEW

SEQ ID NO: 1051 - protein, 14 aa, Artificial sequence
  Synthetic peptide
KEWCWRWKWMCKPE

SEQ ID NO: 1052 - protein, 14 aa, Artificial sequence
  Synthetic peptide
FETCPSWAYFCLDI

SEQ ID NO: 1053 - protein, 14 aa, Artificial sequence
  Synthetic peptide
AYKCEANDWGCWWL

SEQ ID NO: 1054 - protein, 14 aa, Artificial sequence
  Synthetic peptide
NSWCEDQWHRCWWL

SEQ ID NO: 1055 - protein, 14 aa, Artificial sequence
  Synthetic peptide
WSACYAGHFWCYDL

SEQ ID NO: 1056 - protein, 14 aa, Artificial sequence
  Synthetic peptide
ANWCVSPNWFCMVM

SEQ ID NO: 1057 - protein, 14 aa, Artificial sequence
  Synthetic peptide
WTECYQQEFWCWNL

SEQ ID NO: 1058 - protein, 14 aa, Artificial sequence
  Synthetic peptide
ENTCERWKWMCPPK

SEQ ID NO: 1059 - protein, 14 aa, Artificial sequence
  Synthetic peptide
WLPCHQEGFWCMNF

SEQ ID NO: 1060 - protein, 14 aa, Artificial sequence
  Synthetic peptide
STMCSQWHWMCNPF

SEQ ID NO: 1061 - protein, 14 aa, Artificial sequence
  Synthetic peptide
IFGCHWWDVDCYQF

SEQ ID NO: 1062 - protein, 14 aa, Artificial sequence
  Synthetic peptide
IYGCKWWDIQCYDI

SEQ ID NO: 1063 - protein, 14 aa, Artificial sequence
  Synthetic peptide
PDWCIDPDWWCKFW

SEQ ID NO: 1064 - protein, 14 aa, Artificial sequence
  Synthetic peptide
QGHCTRWPWMCPPY

SEQ ID NO: 1065 - protein, 14 aa, Artificial sequence
  Synthetic peptide
WQECYREGFWCLQT

SEQ ID NO: 1066 - protein, 14 aa, Artificial sequence
  Synthetic peptide
WFDCYGPGFKCWSP

SEQ ID NO: 1067 - protein, 14 aa, Artificial sequence
  Synthetic peptide
GVRCPKGHLWCLYP

SEQ ID NO: 1068 - protein, 14 aa, Artificial sequence
  Synthetic peptide
HWACGYWPWSCKWV

SEQ ID NO: 1069 - protein, 14 aa, Artificial sequence
  Synthetic peptide
GPACHSPWWWCVFG

SEQ ID NO: 1070 - protein, 14 aa, Artificial sequence
  Synthetic peptide
TTWCISPMWFCSQQ

SEQ ID NO: 1071 - protein, 14 aa, Artificial sequence
  Synthetic peptide
HKFCPPWAIFCWDF

SEQ ID NO: 1072 - protein, 14 aa, Artificial sequence
  Synthetic peptide
PDWCVSPRWYCNMW

SEQ ID NO: 1073 - protein, 14 aa, Artificial sequence
  Synthetic peptide
VWKCHWFGMDCEPT

SEQ ID NO: 1074 - protein, 14 aa, Artificial sequence
  Synthetic peptide
KKHCQIWTWMCAPK

SEQ ID NO: 1075 - protein, 14 aa, Artificial sequence
  Synthetic peptide
WFQCGSTLFWCYNL

SEQ ID NO: 1076 - protein, 14 aa, Artificial sequence
  Synthetic peptide
WSPCYDHYFYCYTI

SEQ ID NO: 1077 - protein, 14 aa, Artificial sequence
  Synthetic peptide
SWMCGFFKEVCMWV

SEQ ID NO: 1078 - protein, 14 aa, Artificial sequence
  Synthetic peptide
EMLCMIHPVFCNPH

SEQ ID NO: 1079 - protein, 14 aa, Artificial sequence
  Synthetic peptide
LKTCNLWPWMCPPL

SEQ ID NO: 1080 - protein, 14 aa, Artificial sequence
  Synthetic peptide
VVGCKWYEAWCYNK

SEQ ID NO: 1081 - protein, 14 aa, Artificial sequence
  Synthetic peptide
PIHCTQWAWMCPPT

SEQ ID NO: 1082 - protein, 14 aa, Artificial sequence
  Synthetic peptide
DSNCPWYFLSCVIF

SEQ ID NO: 1083 - protein, 14 aa, Artificial sequence
  Synthetic peptide
HIWCNLAMMKCVEM

SEQ ID NO: 1084 - protein, 14 aa, Artificial sequence
  Synthetic peptide
NLQCIYFLGKCIYF

SEQ ID NO: 1085 - protein, 14 aa, Artificial sequence
  Synthetic peptide
AWRCMWFSDVCTPG

SEQ ID NO: 1086 - protein, 14 aa, Artificial sequence
  Synthetic peptide
WFRCFLDADWCTSV

SEQ ID NO: 1087 - protein, 14 aa, Artificial sequence
  Synthetic peptide
EKICQMWSWMCAPP

SEQ ID NO: 1088 - protein, 14 aa, Artificial sequence
  Synthetic peptide
WFYCHLNKSECTEP

SEQ ID NO: 1089 - protein, 14 aa, Artificial sequence
  Synthetic peptide
FWRCAIGIDKCKRV

SEQ ID NO: 1090 - protein, 14 aa, Artificial sequence
  Synthetic peptide
NLGCKWYEVWCFTY

SEQ ID NO: 1091 - protein, 14 aa, Artificial sequence
  Synthetic peptide
IDLCNMWDGMCYPP

SEQ ID NO: 1092 - protein, 14 aa, Artificial sequence
  Synthetic peptide
EMPCNIWGWMCPPV

SEQ ID NO: 1093 - protein, 18 aa, Artificial sequence
  Synthetic peptide
WFRCVLTGIVDWSECFGL

SEQ ID NO: 1094 - protein, 18 aa, Artificial sequence
  Synthetic peptide
GFSCTFGLDEFYVDCSPF

SEQ ID NO: 1095 - protein, 18 aa, Artificial sequence
  Synthetic peptide
LPWCHDQVNADWGFCMLW

SEQ ID NO: 1096 - protein, 18 aa, Artificial sequence
  Synthetic peptide
YPTCSEKFWIYGQTCVLW

SEQ ID NO: 1097 - protein, 18 aa, Artificial sequence
  Synthetic peptide
LGPCPIHHGPWPQYCVYW

SEQ ID NO: 1098 - protein, 18 aa, Artificial sequence
  Synthetic peptide
PFPCETHQISWLGHCLSF

SEQ ID NO: 1099 - protein, 18 aa, Artificial sequence
  Synthetic peptide
HWGCEDLMWSWHPLCRRP

SEQ ID NO: 1100 - protein, 18 aa, Artificial sequence
  Synthetic peptide
LPLCDADMMPTIGFCVAY

SEQ ID NO: 1101 - protein, 18 aa, Artificial sequence
  Synthetic peptide
SHWCETTFWMNYAKCVHA

SEQ ID NO: 1102 - protein, 18 aa, Artificial sequence
  Synthetic peptide
LPKCTHVPFDQGGFCLWY

SEQ ID NO: 1103 - protein, 18 aa, Artificial sequence
  Synthetic peptide
FSSCWSPVSRQDMFCVFY

SEQ ID NO: 1104 - protein, 17 aa, Artificial sequence
  Synthetic peptide
SHKCEYSGWLQPLCYRP

SEQ ID NO: 1105 - protein, 18 aa, Artificial sequence
  Synthetic peptide
PWWCQDNYVQHMLHCDSP

SEQ ID NO: 1106 - protein, 18 aa, Artificial sequence
  Synthetic peptide
WFRCMLMNSFDAFQCVSY

SEQ ID NO: 1107 - protein, 18 aa, Artificial sequence
  Synthetic peptide
PDACRDQPWYMFMGCMLG

SEQ ID NO: 1108 - protein, 14 aa, Artificial sequence
  Synthetic peptide
FLACFVEFELCFDS

SEQ ID NO: 1109 - protein, 18 aa, Artificial sequence
  Synthetic peptide
SAYCIITESDPYVLCVPL

SEQ ID NO: 1110 - protein, 18 aa, Artificial sequence
  Synthetic peptide
PSICESYSTMWLPMCQHN

SEQ ID NO: 1111 - protein, 18 aa, Artificial sequence
  Synthetic peptide
WLDCHDDSWAWTKMCRSH

SEQ ID NO: 1112 - protein, 18 aa, Artificial sequence
  Synthetic peptide
YLNCVMMNTSPFVECVFN

SEQ ID NO: 1113 - protein, 18 aa, Artificial sequence
  Synthetic peptide
YPWCDGFMIQQGITCMFY

SEQ ID NO: 1114 - protein, 18 aa, Artificial sequence
  Synthetic peptide
FDYCTWLNGFKDWKCWSR

SEQ ID NO: 1115 - protein, 18 aa, Artificial sequence
  Synthetic peptide
LPLCNLKEISHVQACVLF

SEQ ID NO: 1116 - protein, 18 aa, Artificial sequence
  Synthetic peptide
SPECAFARWLGIEQCQRD

SEQ ID NO: 1117 - protein, 18 aa, Artificial sequence
  Synthetic peptide
YPQCFNLHLLEWTECDWF

SEQ ID NO: 1118 - protein, 18 aa, Artificial sequence
  Synthetic peptide
RWRCEIYDSEFLPKCWFF

SEQ ID NO: 1119 - protein, 14 aa, Artificial sequence
  Synthetic peptide
LVGCDNVWHRCKLF

SEQ ID NO: 1120 - protein, 18 aa, Artificial sequence
  Synthetic peptide
AGWCHVWGEMFGMGCSAL

SEQ ID NO: 1121 - protein, 18 aa, Artificial sequence
  Synthetic peptide
HHECEWMARWMSLDCVGL

SEQ ID NO: 1122 - protein, 18 aa, Artificial sequence
  Synthetic peptide
FPMCGIAGMKDFDFCVWY

SEQ ID NO: 1123 - protein, 18 aa, Artificial sequence
  Synthetic peptide
RDDCTFWPEWLWKLCERP

SEQ ID NO: 1124 - protein, 18 aa, Artificial sequence
  Synthetic peptide
YNFCSYLFGVSKEACQLP

SEQ ID NO: 1125 - protein, 18 aa, Artificial sequence
  Synthetic peptide
AHWCEQGPWRYGNICMAY

SEQ ID NO: 1126 - protein, 18 aa, Artificial sequence
  Synthetic peptide
NLVCGKISAWGDEACARA

SEQ ID NO: 1127 - protein, 18 aa, Artificial sequence
  Synthetic peptide
HNVCTIMGPSMKWFCWND

SEQ ID NO: 1128 - protein, 18 aa, Artificial sequence
  Synthetic peptide
NDLCAMWGWRNTIWCQNS

SEQ ID NO: 1129 - protein, 18 aa, Artificial sequence
  Synthetic peptide
PPFCQNDNDMLQSLCKLL

SEQ ID NO: 1130 - protein, 18 aa, Artificial sequence
  Synthetic peptide
WYDCNVPNELLSGLCRLF

SEQ ID NO: 1131 - protein, 18 aa, Artificial sequence
  Synthetic peptide
YGDCDQNHWMWPFTCLSL

SEQ ID NO: 1132 - protein, 18 aa, Artificial sequence
  Synthetic peptide
GWMCHFDLHDWGATCQPD

SEQ ID NO: 1133 - protein, 18 aa, Artificial sequence
  Synthetic peptide
YFHCMFGGHEFEVHCESF

SEQ ID NO: 1134 - protein, 12 aa, Artificial sequence
  Synthetic peptide
AYWCWHGQCVRF

SEQ ID NO: 1135 - protein, 19 aa, Artificial sequence
  Synthetic peptide
SEHWTFTDWDGNEWWVRPF

SEQ ID NO: 1136 - protein, 20 aa, Artificial sequence
  Synthetic peptide
MEMLDSLFELLKDMVPISKA

SEQ ID NO: 1137 - protein, 19 aa, Artificial sequence
  Synthetic peptide
SPPEEALMEWLGWQYGKFT

SEQ ID NO: 1138 - protein, 20 aa, Artificial sequence
  Synthetic peptide
SPENLLNDLYILMTKQEWYG

SEQ ID NO: 1139 - protein, 20 aa, Artificial sequence
  Synthetic peptide
FHWEEGIPFHVVTPYSYDRM

SEQ ID NO: 1140 - protein, 19 aa, Artificial sequence
  Synthetic peptide
KRLLEQFMNDLAELVSGHS

SEQ ID NO: 1141 - protein, 20 aa, Artificial sequence
  Synthetic peptide
DTRDALFQEFYEFVRSRLVI

SEQ ID NO: 1142 - protein, 20 aa, Artificial sequence
  Synthetic peptide
RMSAAPRPLTYRDIMDQYWH

SEQ ID NO: 1143 - protein, 20 aa, Artificial sequence
  Synthetic peptide
NDKAHFFEMFMFDVHNFVES

SEQ ID NO: 1144 - protein, 20 aa, Artificial sequence
  Synthetic peptide
QTQAQKIDGLWELLQSIRNQ

SEQ ID NO: 1145 - protein, 18 aa, Artificial sequence
  Synthetic peptide
MLSEFEEFLGNLVHRQEA

SEQ ID NO: 1146 - protein, 20 aa, Artificial sequence
  Synthetic peptide
YTPKMGSEWTSFWHNRIHYL

SEQ ID NO: 1147 - protein, 20 aa, Artificial sequence
  Synthetic peptide
LNDTLLRELKMVLNSLSDMK

SEQ ID NO: 1148 - protein, 20 aa, Artificial sequence
  Synthetic peptide
FDVERDLMRWLEGFMQSAAT

SEQ ID NO: 1149 - protein, 20 aa, Artificial sequence
  Synthetic peptide
HHGWNYLRKGSAPQWFEAWV

SEQ ID NO: 1150 - protein, 20 aa, Artificial sequence
  Synthetic peptide
VESLHQLQMWLDQKLASGPH

SEQ ID NO: 1151 - protein, 18 aa, Artificial sequence
  Synthetic peptide
RATLLKDFWQLVEGYGDN

SEQ ID NO: 1152 - protein, 16 aa, Artificial sequence
  Synthetic peptide
EELLREFYRFVSAFDY

SEQ ID NO: 1153 - protein, 20 aa, Artificial sequence
  Synthetic peptide
GLLDEFSHFIAEQFYQMPGG

SEQ ID NO: 1154 - protein, 20 aa, Artificial sequence
  Synthetic peptide
YREMSMLEGLLDVLERLQHY

SEQ ID NO: 1155 - protein, 20 aa, Artificial sequence
  Synthetic peptide
HNSSQMLLSELIMLVGSMMQ

SEQ ID NO: 1156 - protein, 20 aa, Artificial sequence
  Synthetic peptide
WREHFLNSDYIRDKLIAIDG

SEQ ID NO: 1157 - protein, 19 aa, Artificial sequence
  Synthetic peptide
QFPFYVFDDLPAQLEYWIA

SEQ ID NO: 1158 - protein, 20 aa, Artificial sequence
  Synthetic peptide
EFFHWLHNHRSEVNHWLDMN

SEQ ID NO: 1159 - protein, 19 aa, Artificial sequence
  Synthetic peptide
EALFQNFFRDVLTLSEREY

SEQ ID NO: 1160 - protein, 20 aa, Artificial sequence
  Synthetic peptide
QYWEQQWMTYFRENGLHVQY

SEQ ID NO: 1161 - protein, 20 aa, Artificial sequence
  Synthetic peptide
NQRMMLEDLWRIMTPMFGRS

SEQ ID NO: 1162 - protein, 20 aa, Artificial sequence
  Synthetic peptide
FLDELKAELSRHYALDDLDE

SEQ ID NO: 1163 - protein, 20 aa, Artificial sequence
  Synthetic peptide
GKLIEGLLNELMQLETFMPD

SEQ ID NO: 1164 - protein, 15 aa, Artificial sequence
  Synthetic peptide
ILLLDEYKKDWKSWF

SEQ ID NO: 1165 - protein, 50 aa, Artificial sequence
  Synthetic peptide
QGHCTRWPWMCPPYGSGSATGGSGSTASSGSGSATGQGHCTRWPWMCPPY

SEQ ID NO: 1166 - protein, 43 aa, Artificial sequence
  Synthetic peptide
WYPCYEGHFWCYDLGSGSTASSGSGSATGWYPCYEGHFWCYDL

SEQ ID NO: 1167 - protein, 50 aa, Artificial sequence
  Synthetic peptide
HTPCPWFAPLCVEWGSGSATGGSGSTASSGSGSATGHTPCPWFAPLCVEW

SEQ ID NO: 1168 - protein, 50 aa, Artificial sequence
  Synthetic peptide
PDWCIDPDWWCKFWGSGSATGGSGSTASSGSGSATGPDWCIDPDWWCKFW

SEQ ID NO: 1169 - protein, 50 aa, Artificial sequence
  Synthetic peptide
ANWCVSPNWFCMVMGSGSATGGSGSTASSGSGSATGANWCVSPNWFCMVM

SEQ ID NO: 1170 - protein, 50 aa, Artificial sequence; identical to SEQ ID NO: 1168
  Synthetic peptide

SEQ ID NO: 1171 - protein, 50 aa, Artificial sequence
  Synthetic peptide
HWACGYWPWSCKWVGSGSATGGSGSTASSGSGSATGHWACGYWPWSCKWV

SEQ ID NO: 1172 - protein, 50 aa, Artificial sequence
  Synthetic peptide
KKHCQIWTWMCAPKGSGSATGGSGSTASSGSGSATGQGHCTRWPWMCPPY

SEQ ID NO: 1173 - protein, 50 aa, Artificial sequence
  Synthetic peptide
QGHCTRWPWMCPPYGSGSATGGSGSTASSGSGSATGKKHCQIWTWMCAPK

SEQ ID NO: 1174 - protein, 50 aa, Artificial sequence; identical to SEQ ID NO: 1172
  Synthetic peptide

SEQ ID NO: 1175 - protein, 36 aa, Artificial sequence
  Synthetic peptide
KKHCQIWTWMCAPKGGGGGGGGQGHCTRWPWMCPPY

SEQ ID NO: 1176 - protein, 34 aa, Artificial sequence
  Synthetic peptide
QGHCTRWPWMCPPYGGGGGGKKHCQIWTWMCAPK

SEQ ID NO: 1177 - protein, 20 aa, Artificial sequence
  Synthetic peptide
VALHGQCTRWPWMCPPQREG

SEQ ID NO: 1178 - protein, 20 aa, Artificial sequence
  Synthetic peptide
YPEQGLCTRWPWMCPPQTLA

SEQ ID NO: 1179 - protein, 20 aa, Artificial sequence
  Synthetic peptide
GLNQGHCTRWPWMCPPQDSN

SEQ ID NO: 1180 - protein, 20 aa, Artificial sequence
  Synthetic peptide
MITQGQCTRWPWMCPPQPSG

SEQ ID NO: 1181 - protein, 20 aa, Artificial sequence
  Synthetic peptide
AGAQEHCTRWPWMCAPNDWI

SEQ ID NO: 1182 - protein, 20 aa, Artificial sequence
  Synthetic peptide
GVNQGQCTRWRWMCPPNGWE

SEQ ID NO: 1183 - protein, 20 aa, Artificial sequence
  Synthetic peptide
LADHGQCIRWPWMCPPEGWE

SEQ ID NO: 1184 - protein, 20 aa, Artificial sequence
  Synthetic peptide
ILEQAQCTRWPWMCPPQRGG

SEQ ID NO: 1185 - protein, 20 aa, Artificial sequence
  Synthetic peptide
TQTHAQCTRWPWMCPPQWEG

SEQ ID NO: 1186 - protein, 20 aa, Artificial sequence
  Synthetic peptide
VVTQGHCTLWPWMCPPQRWR

SEQ ID NO: 1187 - protein, 20 aa, Artificial sequence
  Synthetic peptide
IYPHDQCTRWPWMCPPQPYP

SEQ ID NO: 1188 - protein, 20 aa, Artificial sequence
  Synthetic peptide
SYWQGQCTRWPWMCPPQWRG

SEQ ID NO: 1189 - protein, 20 aa, Artificial sequence
  Synthetic peptide
MWQQGHCTRWPWMCPPQGWG

SEQ ID NO: 1190 - protein, 20 aa, Artificial sequence
  Synthetic peptide
EFTQWHCTRWPWMCPPQRSQ

SEQ ID NO: 1191 - protein, 20 aa, Artificial sequence
  Synthetic peptide
LDDQWQCTRWPWMCPPQGFS

SEQ ID NO: 1192 - protein, 20 aa, Artificial sequence
  Synthetic peptide
YQTQGLCTRWPWMCPPQSQR

SEQ ID NO: 1193 - protein, 20 aa, Artificial sequence
  Synthetic peptide
ESNQGQCTRWPWMCPPQGGW

SEQ ID NO: 1194 - protein, 20 aa, Artificial sequence
  Synthetic peptide
WTDRGPCTRWPWMCPPQANG

SEQ ID NO: 1195 - protein, 20 aa, Artificial sequence
  Synthetic peptide
VGTQGQCTRWPWMCPPYETG

SEQ ID NO: 1196 - protein, 20 aa, Artificial sequence
  Synthetic peptide
PYEQGKCTRWPWMCPPYEVE

SEQ ID NO: 1197 - protein, 20 aa, Artificial sequence
  Synthetic peptide
SEYQGLCTRWPWMCPPQGWK

SEQ ID NO: 1198 - protein, 20 aa, Artificial sequence
  Synthetic peptide
TFSQGHCTRWPWMCPPQGWG

SEQ ID NO: 1199 - protein, 20 aa, Artificial sequence
  Synthetic peptide
PGAHDHCTRWPWMCPPQSRY

SEQ ID NO: 1200 - protein, 20 aa, Artificial sequence
  Synthetic peptide
VAEEWHCRRWPWMCPPQDWR

SEQ ID NO: 1201 - protein, 20 aa, Artificial sequence
  Synthetic peptide
VGTQGHCTRWPWMCPPQPAG

SEQ ID NO: 1202 - protein, 20 aa, Artificial sequence
  Synthetic peptide
EEDQAHCRSWPWMCPPQGWV

SEQ ID NO: 1203 - protein, 20 aa, Artificial sequence
  Synthetic peptide
ADTQGHCTRWPWMCPPQHWF

SEQ ID NO: 1204 - protein, 20 aa, Artificial sequence
  Synthetic peptide
SGPQGHCTRWPWMCAPQGWF

SEQ ID NO: 1205 - protein, 20 aa, Artificial sequence
  Synthetic peptide
TLVQGHCTRWPWMCPPQRWV

SEQ ID NO: 1206 - protein, 20 aa, Artificial sequence
  Synthetic peptide
GMAHGKCTRWAWMCPPQSWK

SEQ ID NO: 1207 - protein, 20 aa, Artificial sequence
  Synthetic peptide
ELYHGQCTRWPWMCPPQSWA

SEQ ID NO: 1208 - protein, 20 aa, Artificial sequence
  Synthetic peptide
VADHGHCTRWPWMCPPQGWG

SEQ ID NO: 1209 - protein, 20 aa, Artificial sequence
  Synthetic peptide
PESQGHCTRWPWMCPPQGWG

SEQ ID NO: 1210 - protein, 20 aa, Artificial sequence
  Synthetic peptide
IPAHGHCTRWPWMCPPQRWR

SEQ ID NO: 1211 - protein, 20 aa, Artificial sequence
  Synthetic peptide
FTVHGHCTRWPWMCPPYGWV

SEQ ID NO: 1212 - protein, 20 aa, Artificial sequence
  Synthetic peptide
PDFPGHCTRWRWMCPPQGWE

SEQ ID NO: 1213 - protein, 20 aa, Artificial sequence
  Synthetic peptide
QLWQGPCTQWPWMCPPKGRY

SEQ ID NO: 1214 - protein, 20 aa, Artificial sequence
  Synthetic peptide
HANDGHCTRWQWMCPPQWGG

SEQ ID NO: 1215 - protein, 20 aa, Artificial sequence
  Synthetic peptide
ETDHGLCTRWPWMCPPYGAR

SEQ ID NO: 1216 - protein, 20 aa, Artificial sequence
  Synthetic peptide
GTWQGLCTRWPWMCPPQGWQ

SEQ ID NO: 1217 - protein, 20 aa, Artificial sequence
  Synthetic peptide
VATQGQCTRWPWMCPPQGWG

SEQ ID NO: 1218 - protein, 20 aa, Artificial sequence
  Synthetic peptide
VATQGQCTRWPWMCPPQRWG

SEQ ID NO: 1219 - protein, 20 aa, Artificial sequence
  Synthetic peptide
QREWYPCYGGHLWCYDLHKA

SEQ ID NO: 1220 - protein, 20 aa, Artificial sequence
  Synthetic peptide
ISAWYSCYAGHFWCWDLKQK

SEQ ID NO: 1221 - protein, 20 aa, Artificial sequence
  Synthetic peptide
WTGWYQCYGGHLWCYDLRRK

SEQ ID NO: 1222 - protein, 20 aa, Artificial sequence
  Synthetic peptide
KTFWYPCYDGHFWCYNLKSS

SEQ ID NO: 1223 - protein, 20 aa, Artificial sequence
  Synthetic  peptide
ESRWYPCYEGHLWCFDLTET

SEQ ID NO: 1224 - protein, 20 aa, Artificial sequence
  Synthetic peptide
MEMLDSLFELLKDMVPISKA

SEQ ID NO: 1225 - protein, 22 aa, Artificial sequence
  Synthetic peptide
RMEMLESLLELLKEIVPMSKAG

SEQ ID NO: 1226 - protein, 22 aa, Artificial sequence
  Synthetic peptide
RMEMLESLLELLKEIVPMSKAR

SEQ ID NO: 1227 - protein, 22 aa, Artificial sequence
  Synthetic peptide
RMEMLESLLELLKDIVPMSKPS

SEQ ID NO: 1228 - protein, 22 aa, Artificial sequence
  Synthetic peptide
GMEMLESLFELLQEIVPMSKAP

SEQ ID NO: 1229 - protein, 22 aa, Artificial sequence
  Synthetic peptide
RMEMLESLLELLKDIVPISNPP

SEQ ID NO: 1230 - protein, 22 aa, Artificial sequence
  Synthetic peptide
RIEMLESLLELLQEIVPISKAE

SEQ ID NO: 1231 - protein, 22 aa, Artificial sequence
  Synthetic peptide
RMEMLQSLLELLKDIVPMSNAR

SEQ ID NO: 1232 - protein, 22 aa, Artificial sequence
  Synthetic peptide
RMEMLESLLELLKEIVPTSNGT

SEQ ID NO: 1233 - protein, 22 aa, Artificial sequence
  Synthetic peptide
RMEMLESLFELLKEIVPMSKAG

SEQ ID NO: 1234 - protein, 22 aa, Artificial sequence
  Synthetic peptide
RMEMLGSLLELLKEIVPMSKAR

SEQ ID NO: 1235 - protein, 22 aa, Artificial sequence
  Synthetic peptide
QMELLDSLFELLKEIVPKSQPA

SEQ ID NO: 1236 - protein, 22 aa, Artificial sequence
  Synthetic peptide
RMEMLDSLLELLKEIVPMSNAR

SEQ ID NO: 1237 - protein, 22 aa, Artificial sequence
  Synthetic peptide
RMEMLESLLELLHEIVPMSQAG

SEQ ID NO: 1238 - protein, 22 aa, Artificial sequence
  Synthetic peptide
QMEMLESLLQLLKEIVPMSKAS

SEQ ID NO: 1239 - protein, 22 aa, Artificial sequence
  Synthetic peptide
RMEMLDSLLELLKDMVPMTTGA

SEQ ID NO: 1240 - protein, 22 aa, Artificial sequence
  Synthetic peptide
RIEMLESLLELLKDMVPMANAS

SEQ ID NO: 1241 - protein, 22 aa, Artificial sequence
  Synthetic peptide
RMEMLESLLQLLNEIVPMSRAR

SEQ ID NO: 1242 - protein, 22 aa, Artificial sequence
  Synthetic peptide
RMEMLESLFDLLKELVPMSKGV

SEQ ID NO: 1243 - protein, 22 aa, Artificial sequence
  Synthetic peptide
RIEMLESLLELLKDIVPIQKAR

SEQ ID NO: 1244 - protein, 22 aa, Artificial sequence
  Synthetic peptide
RMELLESLFELLKDMVPMSDSS

SEQ ID NO: 1245 - protein, 22 aa, Artificial sequence
  Synthetic peptide
RMEMLESLLEVLQEIVPRAKGA

SEQ ID NO: 1246 - protein, 22 aa, Artificial sequence
  Synthetic peptide
RMEMLDSLLQLLNEIVPMSHAR

SEQ ID NO: 1247 - protein, 22 aa, Artificial sequence
  Synthetic peptide
RMEMLESLLELLKDIVPMSNAG

SEQ ID NO: 1248 - protein, 22 aa, Artificial sequence
  Synthetic peptide
RMEMLQSLFELLKGMVPISKAG

SEQ ID NO: 1249 - protein, 22 aa, Artificial sequence
  Synthetic peptide
RMEMLESLLELLKEIVPNSTAA

SEQ ID NO: 1250 - protein, 22 aa, Artificial sequence
  Synthetic peptide
RMEMLQSLLELLKEIVPISKAG

SEQ ID NO: 1251 - protein, 22 aa, Artificial sequence
  Synthetic peptide
RIEMLDSLLELLNELVPMSKAR

SEQ ID NO: 1252 - protein, 20 aa, Artificial sequence
  Synthetic peptide
HHGWNYLRKGSAPQWFEAWV

SEQ ID NO: 1253 - protein, 22 aa, Artificial sequence
  Synthetic peptide
QVESLQQLLMWLDQKLASGPQG

SEQ ID NO: 1254 - protein, 22 aa, Artificial sequence
  Synthetic peptide
RMELLESLFELLKEMVPRSKAV

SEQ ID NO: 1255 - protein, 22 aa, Artificial sequence
  Synthetic peptide
QAVSLQHLLMWLDQKLASGPQH

SEQ ID NO: 1256 - protein, 22 aa, Artificial sequence
  Synthetic peptide
DEDSLQQLLMWLDQKLASGPQL

SEQ ID NO: 1257 - protein, 22 aa, Artificial sequence
  Synthetic peptide
PVASLQQLLIWLDQKLAQGPHA

SEQ ID NO: 1258 - protein, 22 aa, Artificial sequence
  Synthetic peptide
EVDELQQLLNWLDHKLASGPLQ

SEQ ID NO: 1259 - protein, 22 aa, Artificial sequence
  Synthetic peptide
DVESLEQLLMWLDHQLASGPHG

SEQ ID NO: 1260 - protein, 22 aa, Artificial sequence
  Synthetic peptide
QVDSLQQVLLWLEHKLALGPQV

SEQ ID NO: 1261 - protein, 22 aa, Artificial sequence
  Synthetic peptide
GDESLQHLLMWLEQKLALGPHG

SEQ ID NO: 1262 - protein, 22 aa, Artificial sequence
  Synthetic peptide
QIEMLESLLDLLRDMVPMSNAF

SEQ ID NO: 1263 - protein, 22 aa, Artificial sequence
  Synthetic peptide
EVDSLQQLLMWLDQKLASGPQA

SEQ ID NO: 1264 - protein, 22 aa, Artificial sequence
  Synthetic peptide
EDESLQQLLIYLDKMLSSGPQV

SEQ ID NO: 1265 - protein, 22 aa, Artificial sequence
  Synthetic peptide
AMDQLHQLLIWLDHKLASGPQA

SEQ ID NO: 1266 - protein, 22 aa, Artificial sequence
  Synthetic peptide
RIEMLESLLELLDEIALIPKAW

SEQ ID NO: 1267 - protein, 22 aa, Artificial sequence
  Synthetic peptide
EVVSLQHLLMWLEHKLASGPDG

SEQ ID NO: 1268 - protein, 22 aa, Artificial sequence
  Synthetic peptide
GGESLQQLLMWLDQQLASGPQR

SEQ ID NO: 1269 - protein, 22 aa, Artificial sequence
  Synthetic peptide
GVESLQQLLIFLDHMLVSGPHD

SEQ ID NO: 1270 - protein, 22 aa, Artificial sequence
  Synthetic peptide
NVESLEHLMMWLERLLASGPYA

SEQ ID NO: 1271 - protein, 22 aa, Artificial sequence
  Synthetic peptide
QVDSLQQLLIWLDHQLASGPKR

SEQ ID NO: 1272 - protein, 22 aa, Artificial sequence
  Synthetic peptide
EVESLQQLLMWLEHKLAQGPQG

SEQ ID NO: 1273 - protein, 22 aa, Artificial sequence
  Synthetic peptide
EVDSLQQLLMWLDQKLASGPHA

SEQ ID NO: 1274 - protein, 22 aa, Artificial sequence
  Synthetic peptide
EVDSLQQLLMWLDQQLASGPQK

SEQ ID NO: 1275 - protein, 22 aa, Artificial sequence
  Synthetic peptide
GVEQLPQLLMWLEQKLASGPQR

SEQ ID NO: 1276 - protein, 22 aa, Artificial sequence
  Synthetic peptide
GEDSLQQLLMWLDQQLAAGPQV

SEQ ID NO: 1277 - protein, 22 aa, Artificial sequence
  Synthetic peptide
ADDSLQQLLMWLDRKLASGPHV

SEQ ID NO: 1278 - protein, 22 aa, Artificial sequence
  Synthetic peptide
PVDSLQQLLIWLDQKLASGPQG

SEQ ID NO: 1279 - protein, 18 aa, Artificial sequence
  Synthetic peptide
RATLLKDFWQLVEGYGDN

SEQ ID NO: 1280 - protein, 22 aa, Artificial sequence
  Synthetic peptide
DWRATLLKEFWQLVEGLGDNLV

SEQ ID NO: 1281 - protein, 22 aa, Artificial sequence
  Synthetic peptide
QSRATLLKEFWQLVEGLGDKQA

SEQ ID NO: 1282 - protein, 22 aa, Artificial sequence
  Synthetic peptide
DGRATLLTEFWQLVQGLGQKEA

SEQ ID NO: 1283 - protein, 22 aa, Artificial sequence
  Synthetic peptide
LARATLLKEFWQLVEGLGEKVV

SEQ ID NO: 1284 - protein, 22 aa, Artificial sequence
  Synthetic peptide
GSRDTLLKEFWQLVVGLGDMQT

SEQ ID NO: 1285 - protein, 22 aa, Artificial sequence
  Synthetic peptide
DARATLLKEFWQLVDAYGDRMV

SEQ ID NO: 1286 - protein, 22 aa, Artificial sequence
  Synthetic peptide
NDRAQLLRDFWQLVDGLGVKSW

SEQ ID NO: 1287 - protein, 22 aa, Artificial sequence
  Synthetic peptide
GVRETLLYELWYLLKGLGANQG

SEQ ID NO: 1288 - protein, 22 aa, Artificial sequence
  Synthetic peptide
QARATLLKEFCQLVGCQGDKLS

SEQ ID NO: 1289 - protein, 22 aa, Artificial sequence
  Synthetic peptide
QERATLLKEFWQLVAGLGQNMR

SEQ ID NO: 1290 - protein, 22 aa, Artificial sequence
  Synthetic peptide
SGRATLLKEFWQLVQGLGEYRW

SEQ ID NO: 1291 - protein, 22 aa, Artificial sequence
  Synthetic peptide
TMRATLLKEFWLFVDGQREMQW

SEQ ID NO: 1292 - protein, 22 aa, Artificial sequence
  Synthetic peptide
GERATLLNDFWQLVDGQGDNTG

SEQ ID NO: 1293 - protein, 22 aa, Artificial sequence
  Synthetic peptide
DERETLLKEFWQLVHGWGDNVA

SEQ ID NO: 1294 - protein, 22 aa, Artificial sequence
  Synthetic peptide
GGRATLLKELWQLLEGQGANLV

SEQ ID NO: 1295 - protein, 22 aa, Artificial sequence
  Synthetic peptide
TARATLLNELVQLVKGYGDKLV

SEQ ID NO: 1296 - protein, 22 aa, Artificial sequence
  Synthetic peptide
GMRATLLQEFWQLVGGQGDNWM

SEQ ID NO: 1297 - protein, 22 aa, Artificial sequence
  Synthetic peptide
STRATLLNDLWQLMKGWAEDRG

SEQ ID NO: 1298 - protein, 22 aa, Artificial sequence
  Synthetic peptide
SERATLLKELWQLVGGWGDNFG

SEQ ID NO: 1299 - protein, 22 aa, Artificial sequence
  Synthetic peptide
VGRATLLKEFWQLVEGLVGQSR

SEQ ID NO: 1300 - protein, 22 aa, Artificial sequence
  Synthetic peptide
EIRATLLKEFWQLVDEWREQPN

SEQ ID NO: 1301 - protein, 22 aa, Artificial sequence
  Synthetic peptide
QLRATLLKEFLQLVHGLGETDS

SEQ ID NO: 1302 - protein, 22 aa, Artificial sequence
  Synthetic peptide
TQRATLLKEFWQLIEGLGGKHV

SEQ ID NO: 1303 - protein, 22 aa, Artificial sequence
  Synthetic peptide
HYRATLLKEFWQLVDGLREQGV

SEQ ID NO: 1304 - protein, 22 aa, Artificial sequence
  Synthetic peptide
QSRVTLLREFWQLVESYRPIVN

SEQ ID NO: 1305 - protein, 22 aa, Artificial sequence
  Synthetic peptide
LSRATLLNEFWQFVDGQRDKRM

SEQ ID NO: 1306 - protein, 22 aa, Artificial sequence
  Synthetic peptide
WDRATLLNDFWHLMEELSQKPG

SEQ ID NO: 1307 - protein, 22 aa, Artificial sequence
  Synthetic peptide
QERATLLKEFWRMVEGLGKNRG

SEQ ID NO: 1308 - protein, 22 aa, Artificial sequence
  Synthetic peptide
NERATLLREFWQLVGGYGVNQR

SEQ ID NO: 1309 - protein, 20 aa, Artificial sequence
  Synthetic peptide
YREMSMLEGLLDVLERLQHY

SEQ ID NO: 1310 - protein, 22 aa, Artificial sequence
  Synthetic peptide
HQRDMSMLWELLDVLDGLRQYS

SEQ ID NO: 1311 - protein, 22 aa, Artificial sequence
  Synthetic peptide
TQRDMSMLDGLLEVLDQLRQQR

SEQ ID NO: 1312 - protein, 22 aa, Artificial sequence
  Synthetic peptide
TSRDMSLLWELLEELDRLGHQR

SEQ ID NO: 1313 - protein, 22 aa, Artificial sequence
  Synthetic peptide
MQHDMSMLYGLVELLESLGHQI

SEQ ID NO: 1314 - protein, 22 aa, Artificial sequence
  Synthetic peptide
WNRDMRMLESLFEVLDGLRQQV

SEQ ID NO: 1315 - protein, 22 aa, Artificial sequence
  Synthetic peptide
GYRDMSMLEGLLAVLDRLGPQL

SEQ ID NO: 1316 - protein, 22 aa, Artificial sequence
  Synthetic peptide
TQRDMSMLEGLLEVLDRLGQQR

SEQ ID NO: 1317 - protein, 22 aa, Artificial sequence
  Synthetic peptide
WYRDMSMLEGLLEVLDRLGQQR

SEQ ID NO: 1318 - protein, 20 aa, Artificial sequence
  Synthetic peptide
HNSSQMLLSELIMLVGSMMQ

SEQ ID NO: 1319 - protein, 22 aa, Artificial sequence
  Synthetic peptide
TQNSRQMLLSDFMMLVGSMIQG

SEQ ID NO: 1320 - protein, 22 aa, Artificial sequence
  Synthetic peptide
MQTSRHILLSEFMMLVGSIMHG

SEQ ID NO: 1321 - protein, 22 aa, Artificial sequence
  Synthetic peptide
HDNSRQMLLSDLLHLVGTMIQG

SEQ ID NO: 1322 - protein, 22 aa, Artificial sequence
  Synthetic peptide
MENSRQNLLRELIMLVGNMSHQ

SEQ ID NO: 1323 - protein, 22 aa, Artificial sequence
  Synthetic peptide
QDTSRHMLLREFMMLVGEMIQG

SEQ ID NO: 1324 - protein, 22 aa, Artificial sequence
  Synthetic peptide
DQNSRQMLLSDLMILVGSMIQG

SEQ ID NO: 1325 - protein, 20 aa, Artificial sequence
  Synthetic peptide
EFFHWLHNHRSEVNHWLDMN

SEQ ID NO: 1326 - protein, 22 aa, Artificial sequence
  Synthetic peptide
NVFFQWVQKHGRVVYQWLDINV

SEQ ID NO: 1327 - protein, 22 aa, Artificial sequence
  Synthetic peptide
FDFLQWLQNHRSEVEHWLVMDV

SEQ ID NO: 1328 - skipped

SEQ ID NO: 1329 - protein, 54 aa, Artificial sequence
  Synthetic peptide
AQWYPCYEGHFWCYDLGSGSATGGSGSTASSGSGSATGWYPCYEGHFWCYDLLE

SEQ ID NO: 1330 - protein, 56 aa, Artificial sequence
  Synthetic peptide
MGAQIFGCKWWDVQCYQFGSGSATGGSGSTASSGSGSATGIFGCKWWDVQCYQFLE

SEQ ID NO: 1331 - protein, 54 aa, Artificial sequence
  Synthetic peptide
AQIFGCKWWDVQCYQFGSGSATGGSGSTASSGSGSATGIFGCKWWDVQCYQFLE

SEQ ID NO: 1332 - protein, 56 aa, Artificial sequence
  Synthetic peptide
MGAQIFGCKWWDVDCYQFGSGSATGGSGSTASSGSGSATGIFGCKWWDVDCYQFLE

SEQ ID NO: 1333 - protein, 54 aa, Artificial sequence
  Synthetic peptide
AQIFGCKWWDVDCYQFGSGSATGGSGSTASSGSGSATGIFGCKWWDVDCYQFLE

SEQ ID NO: 1334 - protein, 68 aa, Artificial sequence
  Synthetic peptide
AQLADHGQCIRWPWMCPPEGWELEGSGSATGGSGSTASSGSGSATGLADHGQCIRWPWMCPPEGWELE

SEQ ID NO: 1335 - protein, 64 aa, Artificial sequence
  Synthetic peptide
AQLADHGQCIRWPWMCPPEGWEGSGSATGGSGGGASSGSGSATGLADHGQCIRWPWMCPPEGWE

SEQ ID NO: 1336 - protein, 68 aa, Artificial sequence
  Synthetic peptide
AQSEYQGLCTRWPWMCPPQGWKLEGSGSATGGSGSTASSGSGSATGSEYQGLCTRWPWMCPPQGWKLE

SEQ ID NO: 1337 - protein, 64 aa, Artificial sequence
  Synthetic peptide
AQSEYQGLCTRWPWMCPPQGWKGSGSATGGSGGGASSGSGSATGSEYQGLCTRWPWMCPPQGWK

SEQ ID NO: 1338 - protein, 67 aa, Artificial sequence
  Synthetic peptide
AQTFSQGHCTRWPWMCPPQGWGLEGSGSATGGSGSTASSGSGSATGTFSQGHCTRWPWMCPPQGWGL

SEQ ID NO: 1339 - protein, 68 aa, Artificial sequence
  Synthetic peptide
AQVADHGHCTRWPWMCPPQGWGLEGSGSATGGSGSTASSGSGSATGVADHGHCTRWPWMCPPQGWGLE

SEQ ID NO: 1340 - protein, 64 aa, Artificial sequence
  Synthetic peptide
AQVADHGHCTRWPWMCPPQGWGGSGSATGGSGGGASSGSGSATGVADHGHCTRWPWVCPPQGWG

SEQ ID NO: 1341 - protein, 68 aa, Artificial sequence
  Synthetic peptide
AQPESQGHCTRWPWMCPPQGWGLEGSGSATGGSGSTASSGSGSATGPESQGHCTRWPWMCPPQGWGLE

SEQ ID NO: 1342 - protein, 64 aa, Artificial sequence
  Synthetic peptide
AQPESQGHCTRWPWMCPPQGWGGSGSATGGSGGGASSGSGSATGPESQGHCTRWPWMCPPQGWG

SEQ ID NO: 1343 - skipped

SEQ ID NO: 1344 - protein, 9 aa, Artificial sequence
  Synthetic peptide
CLCRGDCIC

SEQ ID NO: 1345 - protein, 8 aa, Artificial sequence
  Synthetic peptide
CWDDGWLC

SEQ ID NO: 1346 - protein, 9 aa, Artificial sequence
  Synthetic peptide
CWDDLWWLC

SEQ ID NO: 1347 - protein, 8 aa, Artificial sequence
  Synthetic peptide
CWDDGLMC

SEQ ID NO: 1348 - protein, 8 aa, Artificial sequence
  Synthetic peptide
CWDDGWMC

SEQ ID NO: 1349 - protein, 9 aa, Artificial sequence
  Synthetic peptide
CSWDDGWLC

SEQ ID NO: 1350 - protein, 9 aa, Artificial sequence
  Synthetic peptide
CPDDLWWLC

SEQ ID NO: 1351 - protein, 3 aa, Artificial sequence
  Synthetic peptide
NGR

SEQ ID NO: 1352 - protein, 3 aa, Artificial sequence
  Synthetic peptide
GSL

SEQ ID NO: 1353 - protein, 3 aa, Artificial sequence
  Synthetic peptide
RGD

SEQ ID NO: 1354 - protein, 13 aa, Artificial sequence
  Synthetic peptide
CGRECPRLCQSSC

SEQ ID NO: 1355 - protein, 13 aa, Artificial sequence
  Synthetic peptide
CNGRCVSGCAGRC

SEQ ID NO: 1356 - protein, 8 aa, Artificial sequence
  Synthetic peptide
CLSGSLSC

SEQ ID NO: 1357 - protein, 3 aa, Artificial sequence
  Synthetic peptide
GSL

SEQ ID NO: 1358 - protein, 6 aa, Artificial sequence
  Synthetic peptide
NGRAHA

SEQ ID NO: 1359 - protein, 5 aa, Artificial sequence
  Synthetic peptide
CNGRC

SEQ ID NO: 1360 - protein, 9 aa, Artificial sequence
  Synthetic peptide
CDCRGDCFC

SEQ ID NO: 1361 - protein, 7 aa, Artificial sequence
  Synthetic peptide
CGSLVRC

SEQ ID NO: 1362 - protein, 5 aa, Artificial sequence
  Synthetic peptide
  Misc_feature (3)..(4): Xaa= any amino acid
DLXXL

SEQ ID NO: 1363 - protein, 12 aa, Artificial sequence
  Synthetic peptide
RTDLDSLRTYTL

SEQ ID NO: 1364 - protein, 10 aa, Artificial sequence
  Synthetic peptide
RTDLDSLRTY

SEQ ID NO: 1365 - protein, 9 aa, Artificial sequence
  Synthetic peptide
RTDLDSLRT

SEQ ID NO: 1366 - protein, 8 aa, Artificial sequence
  Synthetic peptide
RTDLDSLR

SEQ ID NO: 1367 - protein, 12 aa, Artificial sequence
  Synthetic peptide
GDLDLLKLRLTL

SEQ ID NO: 1368 - protein, 12 aa, Artificial sequence
  Synthetic peptide
GDLHSLRQLLSR

SEQ ID NO: 1369 - protein, 12 aa, Artificial sequence
  Synthetic peptide
RDDLHMLRLQLW

SEQ ID NO: 1370 - protein, 12 aa, Artificial sequence
  Synthetic peptide
SSDLHALKKRYG

SEQ ID NO: 1371 - protein, 12 aa, Artificial sequence
  Synthetic peptide
RGDLKQLSELTW

SEQ ID NO: 1372 - protein, 7 aa, Artificial sequence
  Synthetic peptide
  Misc_feature (2)..(3): Xaa can be any naturally occurring amino acid
CXXRGDC

SEQ ID NO: 1373 - protein, 27 aa, Artificial sequence
  Synthetic peptide
STGGFDDVYDWARGVSSALTTTLVATR

SEQ ID NO: 1374 - protein, 27 aa, Artificial sequence
  Synthetic peptide
STGGFDDVYDWARRVSSALTTTLVATR

SEQ ID NO: 1375 - protein, 30 aa, Artificial sequence; identical to SEQ ID NO: 941
  Synthetic peptide

SEQ ID NO: 1376 - protein, 30 aa, Artificial sequence; identical to SEQ ID NO: 942
  Synthetic peptide

SEQ ID NO: 1377 - protein, 31 aa, Artificial sequence; identical to SEQ ID NO: 943
  Synthetic peptide

SEQ ID NO: 1378 - protein, 31 aa, Artificial sequence; identical to SEQ ID NO: 944
  Synthetic peptide

SEQ ID NO: 1379 - protein, 18 aa, Artificial sequence
  Synthetic peptide
DVYTKKELIECARRVSEK

SEQ ID NO: 1380 - protein, 5 aa, Artificial sequence
  Synthetic peptide
  Misc_feature (5)..(5): Xaa= any amino acid
RGDGX

SEQ ID NO: 1381 - protein, 7 aa, Artificial sequence
  Synthetic peptide
  Misc_feature (6)..(6): Xaa= any amino acid
CRGDGXC

SEQ ID NO: 1382 - protein, 9 aa, Artificial sequence
  Synthetic peptide
CARRLDAPC

SEQ ID NO: 1383 - protein, 9 aa, Artificial sequence
  Synthetic peptide
CPSRLDSPC

SEQ ID NO: 1384 - protein, 9 aa, Artificial sequence
  Synthetic peptide
CDCRGDCFC

SEQ ID NO: 1385 - protein, 9 aa, Artificial sequence
  Synthetic peptide
CDCRGDCLC

SEQ ID NO: 1386 - protein, 12 aa, Artificial sequence
  Synthetic peptide
RGDLAALSAPPV

SEQ ID NO: 1387 - protein, 12 aa, Artificial sequence
  Synthetic peptide
DITWDQLWDLMK

SEQ ID NO: 1388 - protein, 12 aa, Artificial sequence
  Synthetic peptide
DITWDELWKIMN

SEQ ID NO: 1389 - protein, 12 aa, Artificial sequence
  Synthetic peptide
DYTWFELWDMMQ

SEQ ID NO: 1390 - protein, 12 aa, Artificial sequence
  Synthetic peptide
QITWAQLWNMMK

SEQ ID NO: 1391 - protein, 12 aa, Artificial sequence
  Synthetic peptide
DMTWHDLWTLMS

SEQ ID NO: 1392 - protein, 12 aa, Artificial sequence
  Synthetic peptide
DYSWHDLWEMMS

SEQ ID NO: 1393 - protein, 12 aa, Artificial sequence
  Synthetic peptide
EITWDQLWEVMN

SEQ ID NO: 1394 - protein, 12 aa, Artificial sequence
  Synthetic peptide
HVSWEQLWDIMN

SEQ ID NO: 1395 - protein, 12 aa, Artificial sequence
  Synthetic peptide
HITWDQLWRIMT

SEQ ID NO: 1396 - protein, 13 aa, Artificial sequence
  Synthetic peptide
RNMSWLELWEHMK

SEQ ID NO: 1397 - protein, 18 aa, Artificial sequence
  Synthetic peptide
AEWTWDQLWHVMNPAESQ

SEQ ID NO: 1398 - protein, 14 aa, Artificial sequence
  Synthetic peptide
HRAEWLALWEQMSP

SEQ ID NO: 1399 - protein, 14 aa, Artificial sequence
  Synthetic peptide
KKEDWLALWRIMSV

SEQ ID NO: 1400 - protein, 11 aa, Artificial sequence
  Synthetic peptide
ITWDQLWDLMK

SEQ ID NO: 1401 - protein, 12 aa, Artificial sequence
  Synthetic peptide
DITWDQLWDLMK

SEQ ID NO: 1402 - protein, 12 aa, Artificial sequence
  Synthetic peptide
DITWDQLWDLMK

SEQ ID NO: 1403 - protein, 12 aa, Artificial sequence
  Synthetic peptide
DITWDQLWDLMK

SEQ ID NO: 1404 - protein, 16 aa, Artificial sequence
  Synthetic peptide
CQNRYTDLVAIQNKNE

SEQ ID NO: 1405 - protein, 17 aa, Artificial sequence
  Synthetic peptide
AENWADNEPNNKRNNED

SEQ ID NO: 1406 - protein, 19 aa, Artificial sequence
  Synthetic peptide
RKNNKTWTWVGTKKALTNE

SEQ ID NO: 1407 - protein, 13 aa, Artificial sequence
  Synthetic peptide
KKALTNEAENWAD

SEQ ID NO: 1408 - protein, 16 aa, Artificial sequence
  Synthetic peptide
  Misc_feature (3)..(3): Xaa= any amino acid
  Misc_feature (15)..(15): Xaa= any amino acid
CQXRYTDLVAIQNKXE

SEQ ID NO: 1409 - protein, 17 aa, Artificial sequence
  Synthetic peptide
  Misc_feature (13)..(13): Xaa= any amino acid
  Misc_feature (15)..(15): Xaa= any amino acid
AENWADGEPNNKXNXED

SEQ ID NO: 1410 - protein, 30 aa, Artificial sequence; identical to SEQ ID NO: 942
  Synthetic peptide

SEQ ID NO: 1411 - protein, 31 aa, Artificial sequence; identical to SEQ ID NO: 943
  Synthetic peptide

SEQ ID NO: 1412 - protein, 31 aa, Artificial sequence; identical to SEQ ID NO: 944
  Synthetic peptide

SEQ ID NO: 1413 - protein, 18 aa, Artificial sequence
  Synthetic peptide
DVYTKKELIECARRVSEK

SEQ ID NO: 1414 - protein, 27 aa, Artificial sequence
  Synthetic peptide
STGGFDDVYDWARGVSSALTTTLVATR

SEQ ID NO: 1415 - protein, 27 aa, Artificial sequence
  Synthetic peptide
STGGFDDVYDWARRVSSALTTTLVATR

SEQ ID NO: 1416 - protein, 30 aa, Artificial sequence; identical to SEQ ID NO: 941
  Synthetic peptide

SEQ ID NO: 1417 - protein, 20 aa, Artificial sequence
  Synthetic peptide
YIGSRYIGSRYIGSRYIGSR

SEQ ID NO: 1418 - protein, 45 aa, Artificial sequence
  Synthetic peptide
YIGSRYIGSRYIGSRYIGSRYIGSRYIGSRYIGSRYIGSRYIGSR

SEQ ID NO: 1419 - protein, 80 aa, Artificial sequence
  Synthetic peptide
YIGSRYIGSRYIGSRYIGSRYIGSRYIGSRYIGSRYIGSRYIGSRYIGSRYIGSRYIGSRYIGSRYIGSRYIGSRYIGSR

SEQ ID NO: 1420 - protein, 125 aa, Artificial sequence
  Synthetic peptide
YIGSRYIGSRYIGSRYIGSRYIGSRYIGSRYIGSRYIGSRYIGSRYIGSRYIGSRYIGSRYIGSRYIGSRYIGSRYIGSRYIGSRYIGSRYIGSRYIGSRYIGSRYIGSRYIGSRYIGSRYIGSR

SEQ ID NO: 1421 - protein, 20 aa, Artificial sequence
  Synthetic peptide
IPCNNKGAHSVGLMWWMLAR

SEQ ID NO: 1422 - protein, 19 aa, Artificial sequence
  Synthetic peptide
YIGSRREDVEILDVPDSGR

SEQ ID NO: 1423 - protein, 14 aa, Artificial sequence
  Synthetic peptide
RGDRGDYIGSRRGD

SEQ ID NO: 1424 - protein, 25 aa, Artificial sequence
  Synthetic peptide
YIGSRYIGSRYIGSRYIGSRYIGSR

SEQ ID NO: 1425 - protein, 19 aa, Artificial sequence
  Synthetic peptide
REDVEILDVYIGSRPDSGR

SEQ ID NO: 1426 - protein, 19 aa, Artificial sequence
  Synthetic peptide
YIGSRREDVEILDVPDSGR

SEQ ID NO: 1427 - protein, 20 aa, Artificial sequence
  Synthetic peptide
TGYTEYTEEWPMGFGYQWSF

SEQ ID NO: 1428 - protein, 20 aa, Artificial sequence
  Synthetic peptide
TDWLSDFPFYEQYFGLMPPG

SEQ ID NO: 1429 - protein, 20 aa, Artificial sequence
  Synthetic peptide
FMRFPNPWKLVEPPQGWYYG

SEQ ID NO: 1430 - protein, 20 aa, Artificial sequence
  Synthetic peptide
VVKAPHFEFLAPPHFHEFPF

SEQ ID NO: 1431 - protein, 20 aa, Artificial sequence
  Synthetic peptide
FSYIWIDETPSNIDRYMLWL

SEQ ID NO: 1432 - protein, 20 aa, Artificial sequence
  Synthetic peptide
VNFPKVPEDVEPWPWSLKLY

SEQ ID NO: 1433 - protein, 20 aa, Artificial sequence
  Synthetic peptide
TWHPKTYEEFALPFFVPEAP

SEQ ID NO: 1434 - protein, 20 aa, Artificial sequence
  Synthetic peptide
WHFGTPYIQQQPGVYWLQAP

SEQ ID NO: 1435 - protein, 20 aa, Artificial sequence
  Synthetic peptide
VWNYGPFFMNFPDSTYFLHE

SEQ ID NO: 1436 - protein, 20 aa, Artificial sequence
  Synthetic peptide
WRIHSKPLDYSHVWFFPADF

SEQ ID NO: 1437 - protein, 20 aa, Artificial sequence
  Synthetic peptide
FWDGNQPPDILVDWPWNPPV

SEQ ID NO: 1438 - protein, 20 aa, Artificial sequence
  Synthetic peptide
FYSLEWLKDHSEFFQTVTEW

SEQ ID NO: 1439 - protein, 20 aa, Artificial sequence
  Synthetic peptide
QFMELLKFFNSPGDSSHHFL

SEQ ID NO: 1440 - protein, 20 aa, Artificial sequence
  Synthetic peptide
TNVDWISNNWEHMKSFFTED

SEQ ID NO: 1441 - protein, 20 aa, Artificial sequence
  Synthetic peptide
PNEKPYQMQSWFPPDWPVPY

SEQ ID NO: 1442 - protein, 20 aa, Artificial sequence
  Synthetic peptide
WSHTEWVPQVWWKPPNHFYV

SEQ ID NO: 1443 - protein, 20 aa, Artificial sequence
  Synthetic peptide
WGEWINDAQVHMHEGFISES

SEQ ID NO: 1444 - protein, 20 aa, Artificial sequence
  Synthetic peptide
VPWEHDHDLWEIISQDWHIA

SEQ ID NO: 1445 - protein, 20 aa, Artificial sequence
  Synthetic peptide
VLHLQDPRGWSNFPPGVLEL

SEQ ID NO: 1446 - protein, 14 aa, Artificial sequence
  Synthetic peptide
IHGCWFTEEGCVWQ

SEQ ID NO: 1447 - protein, 14 aa, Artificial sequence
  Synthetic peptide
YMQCQFARDGCPQW

SEQ ID NO: 1448 - protein, 14 aa, Artificial sequence
  Synthetic peptide
KLQCQYSESGCPTI

SEQ ID NO: 1449 - protein, 14 aa, Artificial sequence
  Synthetic peptide
FLQCEISGGACPAP

SEQ ID NO: 1450 - protein, 14 aa, Artificial sequence
  Synthetic peptide
KLQCEFSTSGCPDL

SEQ ID NO: 1451 - protein, 14 aa, Artificial sequence
  Synthetic peptide
KLQCEFSTQGCPDL

SEQ ID NO: 1452 - protein, 14 aa, Artificial sequence
  Synthetic peptide
KLQCEFSTSGCPWL

SEQ ID NO: 1453 - protein, 14 aa, Artificial sequence
  Synthetic peptide
IQGCWFTEEGCPWQ

SEQ ID NO: 1454 - protein, 18 aa, Artificial sequence
  Synthetic peptide
SFDCDNPWGHVLQSCFGF

SEQ ID NO: 1455 - protein, 18 aa, Artificial sequence
  Synthetic peptide
SFDCDNPWGHKLQSCFGF

SEQ ID NO: 1456 - protein, 18 aa, Artificial sequence
  Synthetic peptide
  Binding (18)..(18): Linker protein bound to residue 18
LPGCKWDLLIKQWVCDPL

SEQ ID NO: 1457 - protein, 18 aa, Artificial sequence
  Synthetic peptide
  Binding (1)..(1): Linker protein bound to residue 1
LPGCKWDLLIKQWVCDPL

SEQ ID NO: 1458 - protein, 36 aa, Artificial sequence
  Synthetic peptide
  Misc_feature (18)..(19): Linker protein between residues 18 and 19
  Binding (36)..(36): Linker protein bound to residue 36
LPGCKWDLLIKQWVCDPLLPGCKWDLLIKQWVCDPL

SEQ ID NO: 1459 - protein, 36 aa, Artificial sequence; identical to SEQ ID NO: 1458
  Synthetic peptide
  Binding (1)..(1): Linker protein bound to residue 1
  Misc_feature (18)..(19): Linker protein between residues 18 and 19

SEQ ID NO: 1460 - protein, 18 aa, Artificial sequence
  Synthetic peptide
  Binding (18)..(18): Linker protein bound to residue 18
SADCYFDILTKSDVCTSS

SEQ ID NO: 1461 - protein, 18 aa, Artificial sequence
  Synthetic peptide
  Binding (1)..(1): Linker protein bound to residue 1
SADCYFDILTKSDVCTSS

SEQ ID NO: 1462 - protein, 34 aa, Artificial sequence
  Synthetic peptide
  Misc_feature (17)..(18): Linker protein between residues 17 and 18
  Binding (34)..(34): Linker protein bound to residue 34
SADCYFDILTKSDVTSSSADCYFDILTKSDVTSS

SEQ ID NO: 1463 - protein, 34 aa, Artificial sequence; identical to SEQ ID NO: 1462
  Synthetic peptide
  Binding (1)..(1): Linker protein bound to residue 1
  Misc_feature (17)..(18): Linker protein between residues 17 and 18

SEQ ID NO: 1464 - protein, 18 aa, Artificial sequence
  Synthetic peptide
  Binding (18)..(18): Linker protein bound to residue 18
FHDCKWDLLTKQWVCHGL

SEQ ID NO: 1465 - protein, 18 aa, Artificial sequence
  Synthetic peptide
  Binding (1)..(1): Linker protein bound to residue 1
FHDCKWDLLTKQWVCHGL

SEQ ID NO: 1466 - protein, 36 aa, Artificial sequence
  Synthetic peptide
  Misc_feature (18)..(19): Linker protein between residues 18 and 19
  Binding (36)..(36): Linker protein bound to residue 36
FHDCKWDLLTKQWVCHGLFHDCKWDLLTKQWVCHGL

SEQ ID NO: 1467 - protein, 36 aa, Artificial sequence; identical to SEQ ID NO: 1466
  Synthetic peptide
  Binding (1)..(1): Linker protein bound to residue 1
  Misc_feature (18)..(19): Linker protein between residues 18 and 19

SEQ ID NO: 1468 - protein, 248 aa, Artificial sequence
  Synthetic peptide
MPGTCFPFPWECTHAGGGGGVDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1469 - protein, 248 aa, Artificial sequence
  Synthetic peptide
MWGACWPFPWECFKEGGGGGVDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1470 - protein, 248 aa, Artificial sequence
  Synthetic peptide
MVPFCDLLTKHCFEAGGGGGVDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1471 - protein, 252 aa, Artificial sequence
  Synthetic peptide
MGSRCKYKWDVLTKQCFHHGGGGGVDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1472 - protein, 252 aa, Artificial sequence
  Synthetic peptide
MLPGCKWDLLIKQWVCDPLGGGGGVDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1473 - protein, 252 aa, Artificial sequence
  Synthetic peptide
MSADCYFDILTKSDVCTSSGGGGGVDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1474 - protein, 252 aa, Artificial sequence
  Synthetic peptide
MSDDCMYDQLTRMFICSNLGGGGGVDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1475 - protein, 252 aa, Artificial sequence
  Synthetic peptide
MDLNCKYDELTYKEWCQFNGGGGGVDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1476 - protein, 252 aa, Artificial sequence
  Synthetic peptide
MFHDCKYDLLTRQMVCHGLGGGGGVDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1477 - protein, 252 aa, Artificial sequence
  Synthetic peptide
MRNHCFWDHLLKQDICPSPGGGGGVDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1478 - protein, 252 aa, Artificial sequence
  Synthetic peptide
MANQCWWDSLTKKNVCEFFGGGGGVDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1479 - protein, 252 aa, Artificial sequence
  Synthetic peptide
MFHDCKWDLLTKQWVCHGLGGGGGVDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1480 - protein, 293 aa, Artificial sequence
  Synthetic peptide
MLPGCKWDLLIKQWVCDPLGSGSATGGSGSTASSGSGSATHMLPGCKWDLLIKQWVCDPLGGGGGVDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1481 - protein, 293 aa, Artificial sequence
  Synthetic peptide
MFHDCKWDLLTKQWVCHGLGSGSATGGSGSTASSGSGSATHMFHDCKWDLLTKQWVCHGLGGGGGVDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1482 - protein, 20 aa, Artificial sequence
  Synthetic peptide
PIRQEECDWDPWTCEHMWEV

SEQ ID NO: 1483 - protein, 20 aa, Artificial sequence
  Synthetic peptide
TNIQEECEWDPWTCDHMPGK

SEQ ID NO: 1484 - protein, 20 aa, Artificial sequence
  Synthetic peptide
WYEQDACEWDPWTCEHMAEV

SEQ ID NO: 1485 - protein, 20 aa, Artificial sequence
  Synthetic peptide
NRLQEVCEWDPWTCEHMENV

SEQ ID NO: 1486 - protein, 20 aa, Artificial sequence
  Synthetic peptide
AATQEECEWDPWTCEHMPRS

SEQ ID NO: 1487 - protein, 20 aa, Artificial sequence
  Synthetic peptide
LRHQEGCEWDPWTCEHMFDW

SEQ ID NO: 1488 - protein, 20 aa, Artificial sequence
  Synthetic peptide
VPRQKDCEWDPWTCEHMYVG

SEQ ID NO: 1489 - protein, 20 aa, Artificial sequence
  Synthetic peptide
SISHEECEWDPWTCEHMQVG

SEQ ID NO: 1490 - protein, 20 aa, Artificial sequence
  Synthetic peptide
WAAQEECEWDPWTCEHMGRM

SEQ ID NO: 1491 - protein, 20 aa, Artificial sequence
  Synthetic peptide
TWPQDKCEWDPWTCEHMGST

SEQ ID NO: 1492 - protein, 20 aa, Artificial sequence
  Synthetic peptide
GHSQEECGWDPWTCEHMGTS

SEQ ID NO: 1493 - protein, 20 aa, Artificial sequence
  Synthetic peptide
QHWQEECEWDPWTCDHMPSK

SEQ ID NO: 1494 - protein, 20 aa, Artificial sequence
  Synthetic peptide
NVRQEKCEWDPWTCEHMPVR

SEQ ID NO: 1495 - protein, 20 aa, Artificial sequence
  Synthetic peptide
KSGQVECNWDPWTCEHMPRN

SEQ ID NO: 1496 - protein, 20 aa, Artificial sequence
  Synthetic peptide
VKTQEHCDWDPWTCEHMREW

SEQ ID NO: 1497 - protein, 20 aa, Artificial sequence
  Synthetic peptide
AWGQEGCDWDPWTCEHMLPM

SEQ ID NO: 1498 - protein, 20 aa, Artificial sequence
  Synthetic peptide
PVNQEDCEWDPWTCEHMPPM

SEQ ID NO: 1499 - protein, 20 aa, Artificial sequence
  Synthetic peptide
RAPQEDCEWDPWTCAHMDIK

SEQ ID NO: 1500 - protein, 20 aa, Artificial sequence
  Synthetic peptide
HGQNMECEWDPWTCEHMFRY

SEQ ID NO: 1501 - protein, 20 aa, Artificial sequence
  Synthetic peptide
PRLQEECVWDPWTCEHMPLR

SEQ ID NO: 1502 - protein, 20 aa, Artificial sequence
  Synthetic peptide
RTTQEKCEWDPWTCEHMESQ

SEQ ID NO: 1503 - protein, 20 aa, Artificial sequence
  Synthetic peptide
QTSQEDCVWDPWTCDHMVSS

SEQ ID NO: 1504 - protein, 20 aa, Artificial sequence
  Synthetic peptide
QVIGRPCEWDPWTCEHLEGL

SEQ ID NO: 1505 - protein, 20 aa, Artificial sequence
  Synthetic peptide
WAQQEECAWDPWTCDHMVGL

SEQ ID NO: 1506 - protein, 20 aa, Artificial sequence
  Synthetic peptide
LPGQEDCEWDPWTCEHMVRS

SEQ ID NO: 1507 - protein, 20 aa, Artificial sequence
  Synthetic peptide
PMNQVECDWDPWTCEHMPRS

SEQ ID NO: 1508 - protein, 20 aa, Artificial sequence
  Synthetic peptide
FGWSHGCEWDPWTCEHMGST

SEQ ID NO: 1509 - protein, 20 aa, Artificial sequence
  Synthetic peptide
KSTQDDCDWDPWTCEHMVGP

SEQ ID NO: 1510 - protein, 20 aa, Artificial sequence
  Synthetic peptide
GPRISTCQWDPWTCEHMDQL

SEQ ID NO: 1511 - protein, 20 aa, Artificial sequence
  Synthetic peptide
STIGDMCEWDPWTCAHMQVD

SEQ ID NO: 1512 - protein, 20 aa, Artificial sequence
  Synthetic peptide
VLGGQGCEWDPWTCRLLQGW

SEQ ID NO: 1513 - protein, 20 aa, Artificial sequence
  Synthetic peptide
VLGGQGCQWDPWTCSHLEDG

SEQ ID NO: 1514 - protein, 20 aa, Artificial sequence
  Synthetic peptide
TTIGSMCEWDPWTCAHMQGG

SEQ ID NO: 1515 - protein, 20 aa, Artificial sequence
  Synthetic peptide
TKGKSVCQWDPWTCSHMQSG

SEQ ID NO: 1516 - protein, 20 aa, Artificial sequence
  Synthetic peptide
TTIGSMCQWDPWTCAHMQGG

SEQ ID NO: 1517 - protein, 20 aa, Artificial sequence
  Synthetic peptide
WVNEVVCEWDPWTCNHWDTP

SEQ ID NO: 1518 - protein, 20 aa, Artificial sequence
  Synthetic peptide
VVQVGMCQWDPWTCKHMRLQ

SEQ ID NO: 1519 - protein, 20 aa, Artificial sequence
  Synthetic peptide
AVGSQTCEWDPWTCAHLVEV

SEQ ID NO: 1520 - protein, 20 aa, Artificial sequence
  Synthetic peptide
QGMKMFCEWDPWTCAHIVYR

SEQ ID NO: 1521 - protein, 20 aa, Artificial sequence
  Synthetic peptide
TTIGSMCQWDPWTCEHMQGG

SEQ ID NO: 1522 - protein, 20 aa, Artificial sequence
  Synthetic peptide
TSQRVGCEWDPWTCQHLTYT

SEQ ID NO: 1523 - protein, 20 aa, Artificial sequence
  Synthetic peptide
QWSWPPCEWDPWTCQTVWPS

SEQ ID NO: 1524 - protein, 20 aa, Artificial sequence
  Synthetic peptide
GTSPSFCQWDPWTCSHMVQG

SEQ ID NO: 1525 - protein, 14 aa, Artificial sequence
  Synthetic peptide
QEECEWDPWTCEHM

SEQ ID NO: 1526 - protein, 22 aa, Artificial sequence
  Synthetic peptide
QNYKPLDELDATLYEHFIFHYT

SEQ ID NO: 1527 - protein, 22 aa, Artificial sequence
  Synthetic peptide
LNFTPLDELEQTLYEQWTLQQS

SEQ ID NO: 1528 - protein, 22 aa, Artificial sequence
  Synthetic peptide
TKFNPLDELEQTLYEQWTLQHQ

SEQ ID NO: 1529 - protein, 22 aa, Artificial sequence
  Synthetic peptide
VKFKPLDALEQTLYEHWMFQQA

SEQ ID NO: 1530 - protein, 22 aa, Artificial sequence
  Synthetic peptide
VKYKPLDELDEILYEQQTFQER

SEQ ID NO: 1531 - protein, 22 aa, Artificial sequence
  Synthetic peptide
TNFMPMDDLEQRLYEQFILQQG

SEQ ID NO: 1532 - protein, 22 aa, Artificial sequence
  Synthetic peptide
SKFKPLDELEQTLYEQWTLQHA

SEQ ID NO: 1533 - protein, 22 aa, Artificial sequence
  Synthetic peptide
QKFQPLDELEQTLYEQFMLQQA

SEQ ID NO: 1534 - protein, 22 aa, Artificial sequence
  Synthetic peptide
QNFKPMDELEDTLYKQFLFQHS

SEQ ID NO: 1535 - protein, 22 aa, Artificial sequence
  Synthetic peptide
YKFTPLDDLEQTLYEQWTLQHV

SEQ ID NO: 1536 - protein, 22 aa, Artificial sequence
  Synthetic peptide
QEYEPLDELDETLYNQWMFHQR

SEQ ID NO: 1537 - protein, 22 aa, Artificial sequence
  Synthetic peptide
SNFMPLDELEQTLYEQFMLQHQ

SEQ ID NO: 1538 - protein, 22 aa, Artificial sequence
  Synthetic peptide
QKYQPLDELDKTLYDQFMLQQG

SEQ ID NO: 1539 - protein, 22 aa, Artificial sequence
  Synthetic peptide
QKFQPLDELEETLYKQWTLQQR

SEQ ID NO: 1540 - protein, 22 aa, Artificial sequence
  Synthetic peptide
VKYKPLDELDEWLYHQFTLHHQ

SEQ ID NO: 1541 - protein, 22 aa, Artificial sequence
  Synthetic peptide
QKFMPLDELDEILYEQFMFQQS

SEQ ID NO: 1542 - protein, 22 aa, Artificial sequence
  Synthetic peptide
QTFQPLDDLEEYLYEQWIRRYH

SEQ ID NO: 1543 - protein, 22 aa, Artificial sequence
  Synthetic peptide
EDYMPLDALDAQLYEQFILLHG

SEQ ID NO: 1544 - protein, 22 aa, Artificial sequence
  Synthetic peptide
HTFQPLDELEETLYYQWLYDQL

SEQ ID NO: 1545 - protein, 22 aa, Artificial sequence
  Synthetic peptide
YKFNPMDELEQTLYEEFLFQHA

SEQ ID NO: 1546 - protein, 22 aa, Artificial sequence
  Synthetic peptide
TNYKPLDELDATLYEHWILQHS

SEQ ID NO: 1547 - protein, 22 aa, Artificial sequence
  Synthetic peptide
QKFKPLDELEQTLYEQWTLQQR

SEQ ID NO: 1548 - protein, 22 aa, Artificial sequence
  Synthetic peptide
TKFQPLDELDQTLYEQWTLQQR

SEQ ID NO: 1549 - protein, 22 aa, Artificial sequence
  Synthetic peptide
TNFQPLDELDQTLYEQWTLQQR

SEQ ID NO: 1550 - protein, 20 aa, Artificial sequence
  Synthetic peptide
KFNPLDELEETLYEQFTFQQ

SEQ ID NO: 1551 - protein, 20 aa, Artificial sequence
  Synthetic peptide
AGGMRPYDGMLGWPNYDVQA

SEQ ID NO: 1552 - protein, 20 aa, Artificial sequence
  Synthetic peptide
QTWDDPCMHILGPVTWRRCI

SEQ ID NO: 1553 - protein, 20 aa, Artificial sequence
  Synthetic peptide
APGQRPYDGMLGWPTYQRIV

SEQ ID NO: 1554 - protein, 20 aa, Artificial sequence
  Synthetic peptide
SGQLRPCEEIFGCGTQNLAL

SEQ ID NO: 1555 - protein, 20 aa, Artificial sequence
  Synthetic peptide
FGDKRPLECMFGGPIQLCPR

SEQ ID NO: 1556 - protein, 20 aa, Artificial sequence
  Synthetic peptide
GQDLRPCEDMFGCGTKDWYG

SEQ ID NO: 1557 - protein, 14 aa, Artificial sequence
  Synthetic peptide
KRPCEEIFGGCTYQ

SEQ ID NO: 1558 - protein, 20 aa, Artificial sequence
  Synthetic peptide
GFEYCDGMEDPFTFGCDKQT

SEQ ID NO: 1559 - protein, 20 aa, Artificial sequence
  Synthetic peptide
KLEYCDGMEDPFTQGCDNQS

SEQ ID NO: 1560 - protein, 20 aa, Artificial sequence
  Synthetic peptide
LQEWCEGVEDPFTFGCEKQR

SEQ ID NO: 1561 - protein, 20 aa, Artificial sequence
  Synthetic peptide
AQDYCEGMEDPFTFGCEMQK

SEQ ID NO: 1562 - protein, 20 aa, Artificial sequence
  Synthetic peptide
LLDYCEGVQDPFTFGCENLD

SEQ ID NO: 1563 - protein, 20 aa, Artificial sequence
  Synthetic peptide
HQEYCEGMEDPFTFGCEYQG

SEQ ID NO: 1564 - protein, 20 aa, Artificial sequence
  Synthetic peptide
MLDYCEGMDDPFTFGCDKQM

SEQ ID NO: 1565 - protein, 20 aa, Artificial sequence
  Synthetic peptide
LQDYCEGVEDPFTFGCENQR

SEQ ID NO: 1566 - protein, 20 aa, Artificial sequence
  Synthetic peptide
LQDYCEGVEDPFTFGCEKQR

SEQ ID NO: 1567 - protein, 18 aa, Artificial sequence
  Synthetic peptide
FDYCEGVEDPFTFGCDNH

SEQ ID NO: 1568 - protein, 14 aa, Artificial sequence
  Synthetic peptide
KRPCEEMWGGCNYD

SEQ ID NO: 1569 - protein, 14 aa, Artificial sequence
  Synthetic peptide
HQICKWDPWTCKHW

SEQ ID NO: 1570 - protein, 14 aa, Artificial sequence
  Synthetic peptide
KRPCEEIFGGCTYQ

SEQ ID NO: 1571 - protein, 14 aa, Artificial sequence
  Synthetic peptide
QEECEWDPWTCEHM

SEQ ID NO: 1572 - protein, 18 aa, Artificial sequence
  Synthetic peptide
FDYCEGVEDPFTFGCDNH

SEQ ID NO: 1573 - protein, 20 aa, Artificial sequence
  Synthetic peptide
KFNPLDELEETLYEQFTFQQ

SEQ ID NO: 1574 - protein, 14 aa, Artificial sequence
  Synthetic peptide
QYGCDGFLYGCMIN

SEQ ID NO: 1575 - protein, 31 aa, Artificial sequence
  Synthetic peptide
MGAQKFNPLDELEETLYEQFTFQQLEGGGGG

SEQ ID NO: 1576 - protein, 28 aa, Artificial sequence
  Synthetic peptide
MKFNPLDELEETLYEQFTFQQLEGGGGG

SEQ ID NO: 1577 - protein, 50 aa, Artificial sequence
  Synthetic peptide
MKFNPLDELEETLYEQFTFQQGSGSATGGSGSTASSGSGSATHLEGGGGG

SEQ ID NO: 1578 - protein, 59 aa, Artificial sequence
  Synthetic peptide
MGAQKFNPLDELEETLYEQFTFQQGGGGGGGGKFNPLDELEETLYEQFTFQQLEGGGGG

SEQ ID NO: 1579 - protein, 55 aa, Artificial sequence
  Synthetic peptide
MKFNPLDELEETLYEQFTFQQGGGGGGGKFNPLDELEETLYEQFTFQQLEGGGGG

SEQ ID NO: 1580 - protein, 25 aa, Artificial sequence
  Synthetic peptide
MGAQQEECEWDPWTCEHMLEGGGGG

SEQ ID NO: 1581 - protein, 44 aa, Artificial sequence
  Synthetic peptide
MQEECEWDPWTCEHMGSGSATGGSGSTASSGSGSATHLEGGGGG

SEQ ID NO: 1582 - protein, 61 aa, Artificial sequence
  Synthetic peptide
MGAQQEECEWDPWTCEHMGSGSATGGSGSTASSGSGSATHQEECEWDPWTCEHMLEGGGGG

SEQ ID NO: 1583 - protein, 29 aa, Artificial sequence
  Synthetic peptide
GGGGGAQKFNPLDELEETLYEQFTFQQLE

SEQ ID NO: 1584 - protein, 51 aa, Artificial sequence
  Synthetic peptide
GGGGGAQGSGSATGGSGSTASSGSGSATHKFNPLDELEETLYEQFTFQQLE

SEQ ID NO: 1585 - protein, 57 aa, Artificial sequence
  Synthetic peptide
GGGGGAQKFNPLDELEETLYEQFTFQQGGGGGGGGKFNPLDELEETLYEQFTFQQLE

SEQ ID NO: 1586 - protein, 23 aa, Artificial sequence
  Synthetic peptide
GGGGGAQQEECEWDPWTCEHMLE

SEQ ID NO: 1587 - protein, 45 aa, Artificial sequence
  Synthetic peptide
GGGGGAQGSGSATGGSGSTASSGSGSATHQEECEWDPWTCEHMLE

SEQ ID NO: 1588 - protein, 59 aa, Artificial sequence
  Synthetic peptide
GGGGGAQQEECEWDPWTCEHMGSGSATGGSGSTASSGSGSATHQEECEWDPWTCEHMLE

SEQ ID NO: 1589 - protein, 74 aa, Artificial sequence
  Synthetic peptide
MGAQEECEWDPWTCEHMGGGGGGGGKFNPLDELEETLYEQFTFQQGSGSATGGSGSTASSGSGSATHLEGGGGG

SEQ ID NO: 1590 - protein, 70 aa, Artificial sequence
  Synthetic peptide
GGGGGAQGSGSATGGSGSTASSGSGSATHKFNPLDELEETLYEQFTFQQGGGGGQEECEWDPWTCEHMLE

SEQ ID NO: 1591 - protein, 29 aa, Artificial sequence
  Synthetic peptide
MGAQFDYCEGVEDPFTFGCDNHLEGGGGG

SEQ ID NO: 1592 - protein, 25 aa, Artificial sequence
  Synthetic peptide
MGAQQYGCDGFLYGCMINLEGGGGG

SEQ ID NO: 1593 - protein, 25 aa, Artificial sequence
  Synthetic peptide
MGAQKRPCEEMWGGCNYDLEGGGGG

SEQ ID NO: 1594 - protein, 25 aa, Artificial sequence
  Synthetic peptide
MGAQHQICKWDPWTCKHWLEGGGGG

SEQ ID NO: 1595 - protein, 25 aa, Artificial sequence
  Synthetic peptide
MGAQKRPCEEIFGGCTYQLEGGGGG

SEQ ID NO: 1596 - protein, 29 aa, Artificial sequence
  Synthetic peptide
GGGGGAQPIRQEECDWDPWTCEHMWEVLE

SEQ ID NO: 1597 - protein, 29 aa, Artificial sequence
  Synthetic peptide
GGGGGAQTNIQEECEWDPWTCDHMPGKLE

SEQ ID NO: 1598 - protein, 29 aa, Artificial sequence
  Synthetic peptide
GGGGGAQWYEQDACEWDPWTCEHMAEVLE

SEQ ID NO: 1599 - protein, 29 aa, Artificial sequence
  Synthetic peptide
GGGGGAQNRLQEVCEWDPWTCEHMENVLE

SEQ ID NO: 1600 - protein, 29 aa, Artificial sequence
  Synthetic peptide
GGGGGAQAATQEECEWDPWTCEHMPRSLE

SEQ ID NO: 1601 - protein, 29 aa, Artificial sequence
  Synthetic peptide
GGGGGAQLRHQEGCEWDPWTCEHMFDWLE

SEQ ID NO: 1602 - protein, 29 aa, Artificial sequence
  Synthetic peptide
GGGGGAQVPRQKDCEWDPWTCEHMYVGLE

SEQ ID NO: 1603 - protein, 29 aa, Artificial sequence
  Synthetic peptide
GGGGGAQSISHEECEWDPWTCEHMQVGLE

SEQ ID NO: 1604 - protein, 29 aa, Artificial sequence
  Synthetic peptide
GGGGGAQWAAQEECEWDPWTCEHMGRMLE

SEQ ID NO: 1605 - protein, 29 aa, Artificial sequence
  Synthetic peptide
GGGGGAQTWPQDKCEWDPWTCEHMGSTLE

SEQ ID NO: 1606 - protein, 29 aa, Artificial sequence
  Synthetic peptide
GGGGGAQGHSQEECGWDPWTCEHMGTSLE

SEQ ID NO: 1607 - protein, 29 aa, Artificial sequence
  Synthetic peptide
GGGGGAQQHWQEECEWDPWTCDHMPSKLE

SEQ ID NO: 1608 - protein, 29 aa, Artificial sequence
  Synthetic peptide
GGGGGAQNVRQEKCEWDPWTCEHMPVRLE

SEQ ID NO: 1609 - protein, 29 aa, Artificial sequence
  Synthetic peptide
GGGGGAQKSGQVECNWDPWTCEHMPRNLE

SEQ ID NO: 1610 - protein, 29 aa, Artificial sequence
  Synthetic peptide
GGGGGAQVKTQEHCDWDPWTCEHMREWLE

SEQ ID NO: 1611 - protein, 29 aa, Artificial sequence
  Synthetic peptide
GGGGGAQAWGQEGCDWDPWTCEHMLPMLE

SEQ ID NO: 1612 - protein, 29 aa, Artificial sequence
  Synthetic peptide
GGGGGAQPVNQEDCEWDPWTCEHMPPMLE

SEQ ID NO: 1613 - protein, 29 aa, Artificial sequence
  Synthetic peptide
GGGGGAQRAPQEDCEWDPWTCAHMDIKLE

SEQ ID NO: 1614 - protein, 29 aa, Artificial sequence
  Synthetic peptide
GGGGGAQHGQNMECEWDPWTCEHMFRYLE

SEQ ID NO: 1615 - protein, 29 aa, Artificial sequence
  Synthetic peptide
GGGGGAQPRLQEECVWDPWTCEHMPLRLE

SEQ ID NO: 1616 - protein, 29 aa, Artificial sequence
  Synthetic peptide
GGGGGAQRTTQEKCEWDPWTCEHMESQLE

SEQ ID NO: 1617 - protein, 29 aa, Artificial sequence
  Synthetic peptide
GGGGGAQQTSQEDCVWDPWTCDHMVSSLE

SEQ ID NO: 1618 - protein, 29 aa, Artificial sequence
  Synthetic peptide
GGGGGAQQVIGRPCEWDPWTCEHLEGLLE

SEQ ID NO: 1619 - protein, 29 aa, Artificial sequence
  Synthetic peptide
GGGGGAQWAQQEECAWDPWTCDHMVGLLE

SEQ ID NO: 1620 - protein, 29 aa, Artificial sequence
  Synthetic peptide
GGGGGAQLPGQEDCEWDPWTCEHMVRSLE

SEQ ID NO: 1621 - protein, 29 aa, Artificial sequence
  Synthetic peptide
GGGGGAQPMNQVECDWDPWTCEHMPRSLE

SEQ ID NO: 1622 - protein, 29 aa, Artificial sequence
  Synthetic peptide
GGGGGAQFGWSHGCEWDPWTCEHMGSTLE

SEQ ID NO: 1623 - protein, 29 aa, Artificial sequence
  Synthetic peptide
GGGGGAQKSTQDDCDWDPWTCEHMVGPLE

SEQ ID NO: 1624 - protein, 29 aa, Artificial sequence
  Synthetic peptide
GGGGGAQGPRISTCQWDPWTCEHMDQLLE

SEQ ID NO: 1625 - protein, 29 aa, Artificial sequence
  Synthetic peptide
GGGGGAQSTIGDMCEWDPWTCAHMQVDLE

SEQ ID NO: 1626 - protein, 29 aa, Artificial sequence
  Synthetic peptide
GGGGGAQVLGGQGCEWDPWTCRLLQGWLE

SEQ ID NO: 1627 - protein, 29 aa, Artificial sequence
  Synthetic peptide
GGGGGAQVLGGQGCQWDPWTCSHLEDGLE

SEQ ID NO: 1628 - protein, 29 aa, Artificial sequence
  Synthetic peptide
GGGGGAQTTIGSMCEWDPWTCAHMQGGLE

SEQ ID NO: 1629 - protein, 29 aa, Artificial sequence
  Synthetic peptide
GGGGGAQTKGKSVCQWDPWTCSHMQSGLE

SEQ ID NO: 1630 - protein, 29 aa, Artificial sequence
  Synthetic peptide
GGGGGAQTTIGSMCQWDPWTCAHMQGGLE

SEQ ID NO: 1631 - protein, 29 aa, Artificial sequence
  Synthetic peptide
GGGGGAQWVNEVVCEWDPWTCNHWDTPLE

SEQ ID NO: 1632 - protein, 29 aa, Artificial sequence
  Synthetic peptide
GGGGGAQVVQVGMCQWDPWTCKHMRLQLE

SEQ ID NO: 1633 - protein, 29 aa, Artificial sequence
  Synthetic peptide
GGGGGAQAVGSQTCEWDPWTCAHLVEVLE

SEQ ID NO: 1634 - protein, 29 aa, Artificial sequence
  Synthetic peptide
GGGGGAQQGMKMFCEWDPWTCAHIVYRLE

SEQ ID NO: 1635 - protein, 29 aa, Artificial sequence
  Synthetic peptide
GGGGGAQTTIGSMCQWDPWTCEHMQGGLE

SEQ ID NO: 1636 - protein, 29 aa, Artificial sequence
  Synthetic peptide
GGGGGAQTSQRVGCEWDPWTCQHLTYTLE

SEQ ID NO: 1637 - protein, 29 aa, Artificial sequence
  Synthetic peptide
GGGGGAQQWSWPPCEWDPWTCQTVWPSLE

SEQ ID NO: 1638 - protein, 29 aa, Artificial sequence
  Synthetic peptide
GGGGGAQGTSPSFCQWDPWTCSHMVQGLE

SEQ ID NO: 1639 - protein, 29 aa, Artificial sequence
  Synthetic peptide
GGGGGAQTQGLHQCEWDPWTCKVLWPSLE

SEQ ID NO: 1640 - protein, 29 aa, Artificial sequence
  Synthetic peptide
GGGGGAQVWRSQVCQWDPWTCNLGGDWLE

SEQ ID NO: 1641 - protein, 29 aa, Artificial sequence
  Synthetic peptide
GGGGGAQDKILEECQWDPWTCQFFYGALE

SEQ ID NO: 1642 - protein, 29 aa, Artificial sequence
  Synthetic peptide
GGGGGAQATFARQCQWDPWTCALGGNWLE

SEQ ID NO: 1643 - protein, 29 aa, Artificial sequence
  Synthetic peptide
GGGGGAQGPAQEECEWDPWTCEPLPLMLE

SEQ ID NO: 1644 - protein, 29 aa, Artificial sequence
  Synthetic peptide
GGGGGAQRPEDMCSQWDPWTWHLQGYCLE

SEQ ID NO: 1645 - protein, 29 aa, Artificial sequence
  Synthetic peptide
GGGGGAQLWQLAVCQWDPQTCDHMGALLE

SEQ ID NO: 1646 - protein, 29 aa, Artificial sequence
  Synthetic peptide
GGGGGAQTQLVSLCEWDPWTCRLLDGWLE

SEQ ID NO: 1647 - protein, 29 aa, Artificial sequence
  Synthetic peptide
GGGGGAQMGGAGRCEWDPWTCQLLQGWLE

SEQ ID NO: 1648 - protein, 29 aa, Artificial sequence
  Synthetic peptide
GGGGGAQMFLPNECQWDPWTCSNLPEALE

SEQ ID NO: 1649 - protein, 29 aa, Artificial sequence
  Synthetic peptide
GGGGGAQFGWSHGCEWDPWTCRLLQGWLE

SEQ ID NO: 1650 - protein, 29 aa, Artificial sequence
  Synthetic peptide
GGGGGAQWPQTEGCQWDPWTCRLLHGWLE

SEQ ID NO: 1651 - protein, 29 aa, Artificial sequence
  Synthetic peptide
GGGGGAQPDTRQGCQWDPWTCRLYGMWLE

SEQ ID NO: 1652 - protein, 29 aa, Artificial sequence
  Synthetic peptide
GGGGGAQTWPQDKCEWDPWTCRLLQGWLE

SEQ ID NO: 1653 - protein, 29 aa, Artificial sequence
  Synthetic peptide
GGGGGAQDKILEECEWDPWTCRLLQGWLE

SEQ ID NO: 1654 - protein, 29 aa, Artificial sequence
  Synthetic peptide
GGGGGAQAATQEECEWDPWTCRLLQGWLE

SEQ ID NO: 1655 - protein, 33 aa, Artificial sequence
  Synthetic peptide
MGAQTNFMPMDDLEQRLYEQFILQQGLEGGGGG

SEQ ID NO: 1656 - protein, 33 aa, Artificial sequence
  Synthetic peptide
MGAQTNYKPLDELDATLYEHWILQHSLEGGGGG

SEQ ID NO: 1657 - protein, 33 aa, Artificial sequence
  Synthetic peptide
MGAQQKYQPLDELDKTLYDQFMLQQGLEGGGGG

SEQ ID NO: 1658 - protein, 33 aa, Artificial sequence
  Synthetic peptide
MGAQLNFTPLDELEQTLYEQWTLQQSLEGGGGG

SEQ ID NO: 1659 - protein, 33 aa, Artificial sequence
  Synthetic peptide
MGAQQKFQPLDELEQTLYEQFMLQQALEGGGGG

SEQ ID NO: 1660 - protein, 33 aa, Artificial sequence
  Synthetic peptide
MGAQQEYEPLDELDETLYNQWMFHQRLEGGGGG

SEQ ID NO: 1661 - protein, 33 aa, Artificial sequence
  Synthetic peptide
MGAQVKYKPLDELDEILYEQQTFQERLEGGGGG

SEQ ID NO: 1662 - protein, 33 aa, Artificial sequence
  Synthetic peptide
MGAQTKFQPLDELDQTLYEQWTLQQRLEGGGGG

SEQ ID NO: 1663 - protein, 33 aa, Artificial sequence
  Synthetic peptide
MGAQTNFQPLDELDQTLYEQWTLQQRLEGGGGG

SEQ ID NO: 1664 - protein, 33 aa, Artificial sequence
  Synthetic peptide
MGAQQNFKPMDELEDTLYKQFLFQHSLEGGGGG

SEQ ID NO: 1665 - protein, 33 aa, Artificial sequence
  Synthetic peptide
MGAQVKYKPLDELDEWLYHQFTLHHQLEGGGGG

SEQ ID NO: 1666 - protein, 33 aa, Artificial sequence
  Synthetic peptide
MGAQYKFTPLDDLEQTLYEQWTLQHVLEGGGGG

SEQ ID NO: 1667 - protein, 33 aa, Artificial sequence
  Synthetic peptide
MGAQQNYKPLDELDATLYEHFIFHYTLEGGGGG

SEQ ID NO: 1668 - protein, 33 aa, Artificial sequence
  Synthetic peptide
MGAQVKFKPLDALEQTLYEHWMFQQALEGGGGG

SEQ ID NO: 1669 - protein, 33 aa, Artificial sequence
  Synthetic peptide
MGAQEDYMPLDALDAQLYEQFILLHGLEGGGGG

SEQ ID NO: 1670 - protein, 33 aa, Artificial sequence
  Synthetic peptide
MGAQYKFNPMDELEQTLYEEFLFQHALEGGGGG

SEQ ID NO: 1671 - protein, 33 aa, Artificial sequence
  Synthetic peptide
MGAQSNFMPLDELEQTLYEQFMLQHQLEGGGGG

SEQ ID NO: 1672 - protein, 33 aa, Artificial sequence
  Synthetic peptide
MGAQQKFQPLDELEETLYKQWTLQQRLEGGGGG

SEQ ID NO: 1673 - protein, 33 aa, Artificial sequence
  Synthetic peptide
MGAQQKFMPLDELDEILYEQFMFQQSLEGGGGG

SEQ ID NO: 1674 - protein, 33 aa, Artificial sequence
  Synthetic peptide
MGAQTKFNPLDELEQTLYEQWTLQHQLEGGGGG

SEQ ID NO: 1675 - protein, 33 aa, Artificial sequence
  Synthetic peptide
MGAQHTFQPLDELEETLYYQWLYDQLLEGGGGG

SEQ ID NO: 1676 - protein, 33 aa, Artificial sequence
  Synthetic peptide
MGAQQKFKPLDELEQTLYEQWTLQQRLEGGGGG

SEQ ID NO: 1677 - protein, 33 aa, Artificial sequence
  Synthetic peptide
MGAQQTFQPLDDLEEYLYEQWIRRYHLEGGGGG

SEQ ID NO: 1678 - protein, 33 aa, Artificial sequence
  Synthetic peptide
MGAQSKFKPLDELEQTLYEQWTLQHALEGGGGG

SEQ ID NO: 1679 - protein, 29 aa, Artificial sequence
  Synthetic peptide
GGGGGAQSGQLRPCEEIFGCGTQNLALLE

SEQ ID NO: 1680 - protein, 29 aa, Artificial sequence
  Synthetic peptide
GGGGGAQAGGMRPYDGMLGWPNYDVQALE

SEQ ID NO: 1681 - protein, 29 aa, Artificial sequence
  Synthetic peptide
GGGGGAQGQDLRPCEDMFGCGTKDWYGLE

SEQ ID NO: 1682 - protein, 29 aa, Artificial sequence
  Synthetic peptide
GGGGGAQAPGQRPYDGMLGWPTYQRIVLE

SEQ ID NO: 1683 - protein, 29 aa, Artificial sequence
  Synthetic  peptide
GGGGGAQQTWDDPCMHILGPVTWRRCILE

SEQ ID NO: 1684 - protein, 29 aa, Artificial sequence
  Synthetic peptide
GGGGGAQFGDKRPLECMFGGPIQLCPRLE

SEQ ID NO: 1685 - protein, 23 aa, Artificial sequence
  Synthetic peptide
GGGGGAQKRPCEEIFGGCTYQLE

SEQ ID NO: 1686 - protein, 29 aa, Artificial sequence
  Synthetic peptide
GGGGGAQLQEWCEGVEDPFTFGCEKQRLE

SEQ ID NO: 1687 - protein, 29 aa, Artificial sequence
  Synthetic peptide
GGGGGAQMLDYCEGMDDPFTFGCDKQMLE

SEQ ID NO: 1688 - protein, 29 aa, Artificial sequence
  Synthetic peptide
GGGGGAQHQEYCEGMEDPFTFGCEYQGLE

SEQ ID NO: 1689 - protein, 29 aa, Artificial sequence
  Synthetic peptide
GGGGGAQLQDYCEGVEDPFTFGCENQRLE

SEQ ID NO: 1690 - protein, 29 aa, Artificial sequence
  Synthetic peptide
GGGGGAQLLDYCEGVQDPFTFGCENLDLE

SEQ ID NO: 1691 - protein, 29 aa, Artificial sequence
  Synthetic peptide
GGGGGAQGFEYCDGMEDPFTFGCDKQTLE

SEQ ID NO: 1692 - protein, 29 aa, Artificial sequence
  Synthetic peptide
GGGGGAQAQDYCEGMEDPFTFGCEMQKLE

SEQ ID NO: 1693 - protein, 29 aa, Artificial sequence
  Synthetic peptide
GGGGGAQLQDYCEGVEDPFTFGCEKQRLE

SEQ ID NO: 1694 - protein, 29 aa, Artificial sequence
  Synthetic peptide
GGGGGAQKLEYCDGMEDPFTQGCDNQSLE

SEQ ID NO: 1695 - protein, 27 aa, Artificial sequence
  Synthetic peptide
GGGGGAQFDYCEGVEDPFTFGCDNHLE

SEQ ID NO: 1696 - protein, 227 aa, Artificial sequence
  Synthetic peptide
DKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

What is claimed is:

1. A compound comprising a structure set out in Formula V

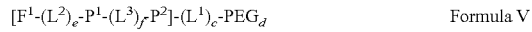

$$[F^1\text{-}(L^2)_e\text{-}P^1\text{-}(L^3)_f\text{-}P^2]\text{-}(L^1)_c\text{-}PEG_d \qquad \text{Formula V}$$

wherein:
$F^1$ is an Fc domain;
wherein $P^1$ and $P^2$ are each independently sequences of pharmacologically active peptides;
$L^1$, $L^2$ and $L^3$ are each independently linkers;
c, e and f are each independently 0 or 1;
d is at least 1; and
wherein the Fc domain is attached at the N-terminus of -$L^2$-$P^1$-$L^3$-$P^2$ and one or more PEG is attached to any reactive moiety in the Fc domain, optionally through linker $L^1$;
said compound having a property of improved bioefficacy when administered in a multidose regimen.

2. The compound of claim 1 which is a multimer.

3. The compound of claim 2 which is a dimer.

4. The compound of claim 1 wherein $P^1$ and/or $P^2$ are independently selected from a peptide set out in any one of Tables 4 through 20.

5. The compound of claim 1 wherein $P^1$ and $P^2$ have the same amino acid sequence as SEQ ID NO:459.

6. The compound of claim 1 wherein PEG has a molecular weight of between about 2 kDa and 100 kDa.

7. The compound of claim 6 wherein said PEG has a molecular weight of between about 6 kDa and 25 kDa.

8. A composition comprising the compound of claim 1, wherein said composition comprises the PEGylated compound in an amount selected from the group consisting of: at least 50% PEGylated compound, at least 75% PEGylated compound, at least 85% PEGylated compound, at least 90% PEGylated compound, at least 95% PEGylated compound.

9. A method of treating a disease or disorder comprising administering a composition comprising the compound of claim 1 in an amount effective to treat the disease or disorder.

10. The method of claim 9, wherein said amount is from 0.1-1000 µg/kg—of body weight or from 0.1-150 µg/kg body weight.

11. A pharmaceutical composition comprising the compound of claim 1 in admixture with a pharmaceutically acceptable carrier thereof.

* * * * *

UNITED STATES PATENT AND TRADEMARK OFFICE
CERTIFICATE OF CORRECTION

| | | |
|---|---|---|
| PATENT NO. | : 8,143,380 B2 | Page 1 of 1 |
| APPLICATION NO. | : 11/631461 | |
| DATED | : March 27, 2012 | |
| INVENTOR(S) | : Walker et al. | |

It is certified that error appears in the above-identified patent and that said Letters Patent is hereby corrected as shown below:

On the Title Page:

The first or sole Notice should read --

Subject to any disclaimer, the term of this patent is extended or adjusted under 35 U.S.C. 154(b) by 241 days.

Signed and Sealed this
Twenty-fourth Day of July, 2012

David J. Kappos
*Director of the United States Patent and Trademark Office*